US009889082B2

(12) United States Patent
Cotsarelis et al.

(10) Patent No.: US 9,889,082 B2
(45) Date of Patent: Feb. 13, 2018

(54) METHODS AND COMPOSITIONS FOR INHIBITING OR REDUCING HAIR LOSS, ACNE, ROSACEA, PROSTATE CANCER, AND BPH

(71) Applicant: The Trustees of the University of Pennsylvania, Philadelphia, PA (US)

(72) Inventors: George Cotsarelis, Berwyn, PA (US); Luis Garza, Baltimore, MD (US)

(73) Assignee: THE TRUSTEES OF THE UNIVERSITY OF PENNSYLVANIA, Philadelphia, PA (US)

( * ) Notice: Subject to any disclaimer, the term of this patent is extended or adjusted under 35 U.S.C. 154(b) by 0 days.

(21) Appl. No.: 14/833,470

(22) Filed: Aug. 24, 2015

(65) Prior Publication Data

US 2016/0346186 A1    Dec. 1, 2016

Related U.S. Application Data

(62) Division of application No. 12/303,998, filed as application No. PCT/US2007/014031 on Jun. 15, 2007, now Pat. No. 9,254,293.

(60) Provisional application No. 60/814,041, filed on Jun. 16, 2006, provisional application No. 60/845,161, filed on Sep. 18, 2006.

(51) Int. Cl.
*A61K 48/00* (2006.01)
*A61K 8/60* (2006.01)
*A01K 67/027* (2006.01)
*A61K 8/365* (2006.01)
*A61Q 7/00* (2006.01)
*A61Q 19/00* (2006.01)
*C12N 5/071* (2010.01)
*C12N 9/02* (2006.01)
*C12N 15/85* (2006.01)
*A61K 8/36* (2006.01)
*A61K 31/557* (2006.01)
*A61K 31/7088* (2006.01)
*A61K 31/713* (2006.01)

(52) U.S. Cl.
CPC ......... *A61K 8/606* (2013.01); *A01K 67/0275* (2013.01); *A61K 8/36* (2013.01); *A61K 8/365* (2013.01); *A61K 31/557* (2013.01); *A61K 31/7088* (2013.01); *A61K 31/713* (2013.01); *A61Q 7/00* (2013.01); *A61Q 19/00* (2013.01); *C12N 5/0627* (2013.01); *C12N 9/0083* (2013.01); *C12N 15/8509* (2013.01); *A01K 2217/05* (2013.01); *A01K 2227/105* (2013.01); *A01K 2267/0368* (2013.01); *C12N 2830/008* (2013.01)

(58) Field of Classification Search
None
See application file for complete search history.

(56) References Cited

U.S. PATENT DOCUMENTS

| 7,405,215 B2 | 7/2008 | Bennani et al. |
| 8,771,765 B1 | 7/2014 | Fernandez |
| 2002/0052416 A1 | 5/2002 | Cheng et al. |
| 2002/0102208 A1 | 8/2002 | Chinn et al. |
| 2004/0054145 A1 | 3/2004 | Gorczynski |
| 2004/0180885 A1 | 9/2004 | Torisu et al. |
| 2004/0213783 A1 | 10/2004 | Liversidge |
| 2005/0014729 A1 | 1/2005 | Pulaski |
| 2005/0084490 A1 | 4/2005 | Adams |
| 2005/0112075 A1 | 5/2005 | Hwang et al. |
| 2005/0222216 A1 | 10/2005 | Iwahashi et al. |
| 2006/0194864 A1 | 8/2006 | Torisu et al. |
| 2010/0172865 A1 | 7/2010 | Shantha et al. |
| 2011/0021599 A1 | 1/2011 | Cotsarelis et al. |
| 2012/0184493 A1 | 7/2012 | Hutchinson |

FOREIGN PATENT DOCUMENTS

| EP | 0249193 A2 | 5/1988 |
| EP | 1170594 A2 | 1/2002 |
| EP | 1435356 A1 | 7/2004 |
| EP | 1666473 A1 | 6/2006 |
| GB | 2407318 A | 4/2005 |
| RU | 2333763 C2 | 9/2008 |

(Continued)

OTHER PUBLICATIONS

Alexopoulos et al. "Design and synthesis of novel biologically active thrombin receptor non-peptide mimetics based on the pharmacophoric cluster Phe/Arg/NH2 of the Ser42-Phe-Leu-Leu-Arg46 motif sequence: platelet aggregation and relaxant activities", J Med Chem 47(13): 3338-52, 2004.
Andronati et al. "Peptidomimetics—antagonists of the fibrinogen receptors: molecular design, structures, properties and therapeutic applications", Curr Med Chem 11(9): 1183-211, 2004.
Aries et al., "Myrtacine regulates arachidonic acid cascade, cyclooxygenase, and lipoxygenase pathways in human keratinocytes: interest in the treatment of inflammatory acne disease", Journal of Investigative Dermatology, vol. 129, No. 3, p. 805, 2009.
Banan et al The ins and outs of RNAi in mammalian cells. Curr Pharm Biotechnol. Oct. 2004;5(5):441-50.

(Continued)

*Primary Examiner* — Kimberly Chong
(74) *Attorney, Agent, or Firm* — Mark S. Cohen; Pearl Cohen Zedek Latzer Baratz LLP

(57) ABSTRACT

This invention provides methods of treating androgenetic alopecia (AGA), acne, rosacea, prostate cancer, and benign prostatic hypertrophy (BPH), comprising the step of contacting a subject with a compound or composition capable of decreasing prostaglandin D2 (PGD2) level or activity, a downstream signaling or receptor pathway thereof, or prostaglandin D2 synthase level or activity; methods of stimulating hair growth, comprising the step of contacting a subject with a compound or composition capable of increasing or decreasing the activity or level of a target gene of the present invention, or with a protein product of the target gene or an analog or mimetic thereof; and methods of testing for AGA and evaluating therapeutic methods thereof, comprising measuring PGD2 levels.

7 Claims, 96 Drawing Sheets

(56) References Cited

FOREIGN PATENT DOCUMENTS

| | | |
|---|---|---|
| WO | WO 2002/042332 A2 | 5/2002 |
| WO | WO 2002/081649 A2 | 10/2002 |
| WO | WO 2003/062200 A2 | 7/2003 |
| WO | WO 2003/066046 A1 | 8/2003 |
| WO | WO 2003/066047 A1 | 8/2003 |
| WO | WO 2003/077947 A1 | 9/2003 |
| WO | WO 2003/097042 A1 | 11/2003 |
| WO | WO 2003/101961 A1 | 12/2003 |
| WO | WO 2003/101981 A1 | 12/2003 |
| WO | WO 2004/007451 A1 | 1/2004 |
| WO | WO 2004/032848 A2 | 4/2004 |
| WO | WO 2004/035543 A1 | 4/2004 |
| WO | WO 2004/106302 A1 | 12/2004 |
| WO | WO 2005/018529 A2 | 3/2005 |
| WO | WO 2005/019171 A1 | 3/2005 |
| WO | WO 2005/040112 A1 | 5/2005 |
| WO | WO 2005/040114 A1 | 5/2005 |
| WO | WO 2005/044260 A1 | 5/2005 |
| WO | WO 2005/054232 A1 | 6/2005 |
| WO | WO 2005/095397 A1 | 10/2005 |
| WO | WO 2005/100321 A1 | 10/2005 |
| WO | WO 2005/102338 A1 | 11/2005 |
| WO | WO 2006/095183 A1 | 9/2006 |
| WO | WO 2006/105109 A2 | 10/2006 |
| WO | WO 2007/107772 A1 | 9/2007 |
| WO | WO 2007/149312 A2 | 12/2007 |
| WO | WO 8008/012511 A1 | 1/2008 |
| WO | WO 2011/014588 A2 | 2/2011 |
| WO | WO 2012/078649 A1 | 6/2012 |
| WO | WO 2013/142295 A1 | 9/2013 |

OTHER PUBLICATIONS

Benavides et al "Impaired hair follicle morphogenesis and cycling with abnormal epidermal differentiation in nackt mice, a cathepsin L-deficient mutation", Am J Pathol. Aug. 2002;161(2):693-703.

Breslin et al, "Non-peptide alphavbeta3 antagonists. Part 6: design and synthesis of alphavbeta3 antagonists containing a pyridone or pyrazinone central scaffold", Bioorg Med Chem Lett 13(10): 1809-12, 2003.

Caudy et al., "Fragile X-related protein and VIG associate with the RNA interference machinery", Genes and Development 16: 2491-96, 2002.

De Jonge et al (Reconstituted influenza virus envelopes as an efficient carrier system for cellular delivery of small-interfering RNAs. Gene Ther. Mar. 2006;13(5):400-11).

Fong et al. "In silico prediction of prostaglandin D2 synthase inhibitors from herbal constituents for the treatment of hair loss" J Ethnopharmacol. Dec. 4, 2015;175:470-80.

Garza et al. "Balding scalp possesses a normal complement of follicle stem cells and gene expression changes implicate inflammation as causative", Journal of Investigative Dermatology, vol. 126, No. suppl. 1, p. 99, 2006.

Garza et al. "Evidence that prostaglandin D2 contributes to development of Androgenetic Alopecia", Journal of Investigative Dermatology, vol. 129, No. Suppl. 1, p. S98, 2009.

Garza et al. "CD200 (high) alpha-6-integrin(high) keratinocytes possess characteristics of early stem cell progeny, are depleted in androgenetic alopecia, and localize to the bulge and secondary hair germ", Journal of Investigative Dermatology, vol. 128, No. suppl. 1, p. S153, 2008.

Garza et al. "Prostaglandin D2 inhibits hair growth and is elevated in bald scalp of men with androgenetic alopecia", Sci Transl Med. Mar. 21, 2012;4(126):126ra34.

Garza et al. "The role of Prostaglandin D2 and its receptor DP-2 in promotion of Androgenetic Alopecia", Jouran of Investigative Dermatology, vol. 130, No. Suppl. 1, Apr. 2010, p. S103.

Govoni et al. "The cycloxygenase-2 inhibitor SC58236 is neuroprotective in an in vivo model of focal ischemia in the rat", Neuroscience Letters, vol. 303, No. 2, pp. 91-94, 2001.

Hill et al. "The mouse Gene Expression Database (GXD): updates and enhancements", 2004, Nucleic Acids Res 32: D568-D571).

International Search Report for PCT Application No. PCT/US13/31825 dated Jul. 11, 2013.

Ishizuka et al., "Ramatroban: a novel dual antagonist of TXA2 receptor and CRTH2, a newly identified prostaglandin D2 receptor", Cardiovascular Drug Reviews, vol. 22, No. 2, pp. 71-90, 2004.

Jiang et al (Gel-based application of siRNA to human epithelial cancer cells induces RNAi-dependent apoptosis. Oligonucleotides. 2004 Winter;14(4):239-48.

Kim et al. "Suppresion of prostate tumor cell growth by stromal cell prostaglandin D synthase-derived products" Cancer Research, vol. 65, No. 14, pp. 6189-6198, 2005.

Leslie et al. "Alopecia universalis treated with bone morphogenetic protein?", British Journal of Dermatology, vol. 154, No. 1, pp. 190-191, 2006.

Naz et al., "Novel human prostate-specific cDNA: molecular cloning, expression, and immunobiology of the recombinant protein", Biochem. Biophys. Res. Commun. 297:1075-84, 2002.

Nielsen "Peptide Nucleic Acids as Therapeutic Agents", Curr. Opin. Struct. Biol. 9:353-57, 1999.

Ohyama et al. "Management of hair loss diseases", Dermatologica Sinica vol. 28, Issue 4, Dec. 2010, pp. 139-145.

Olsen EA, et al., "Transdermal viprostol in the treatment of male pattern baldness". J Am Acad Dermatol. Sep. 1990;23(3 Pt 1):470-2.

Petersen MJ et al (Development of a nude mouse model to study human sebaceous gland physiology and pathophysiology. J Clin Invest. Oct. 1984;74(4):1358-65.

Pettipher et al., "Antagonism of the prostaglandin D2 receptors DP1 and CRTH2 as an approach to treat allergic diseases", Nature Reviews, vol. 62, No. 4, pp. 313-325, 2007.

Pettipher et al. "Update on the development of antagonists of chemoattractant receptor-homologous molecule expressed on Th2 cells (CRTH2). From lead optimization to clinical proof-of-concept in asthma and allergic rhinitis", J Med Chem. Apr. 12, 2012;55(7):2915-31.

Rosenblum et al., "CD200, a 'no danger' signal for hair follicles", Journal of Dermatological Science, vol. 41, No. 3, pp. 165-174, 2006.

Song et al. "NMR for the design of functional mimetics of protein-protein interactions: one key is in the building of bridges", Biochem Cell Biol 76(2-3): 177-188, 1998.

Supplementary European Search Report for European Application No. 13764527.1 dated Feb. 25, 2016.

Vogt et al. "A non-peptide mimetic of Ras-CAAX: selective inhibition of farnesyltransferase and Ras processing", J Biol Chem. 270(2): 660-4, 1995.

Zheng Y et al (Organogenesis from dissociated cells: generation of mature cycling hair follicles from skin-derived cells. J Invest Dermatol. May 2005;124(5):867-76.

Zouboulis et al. "Sebaceous glands and the prostaglandin pathway—key stones of an exciting mosaic", J Invest Dermatol. Nov. 2005;125(5):x-xi.

Colombe et al. "Prostanoid receptors in anagen human haft follicles" Experimental dermatology. Jan. 1, 2008;17(1):63-72.

European Search Report for European Application No. 16196670.0 dated Feb. 28, 2017.

International Search Report for PCT Application No. PCT/US07/14031 dated Aug. 8, 2008.

Supplementary European Search Report for European Application No. 07809581.7 dated Jun. 7, 2010.

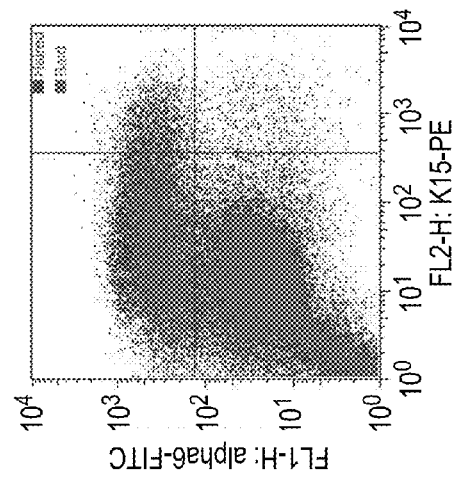
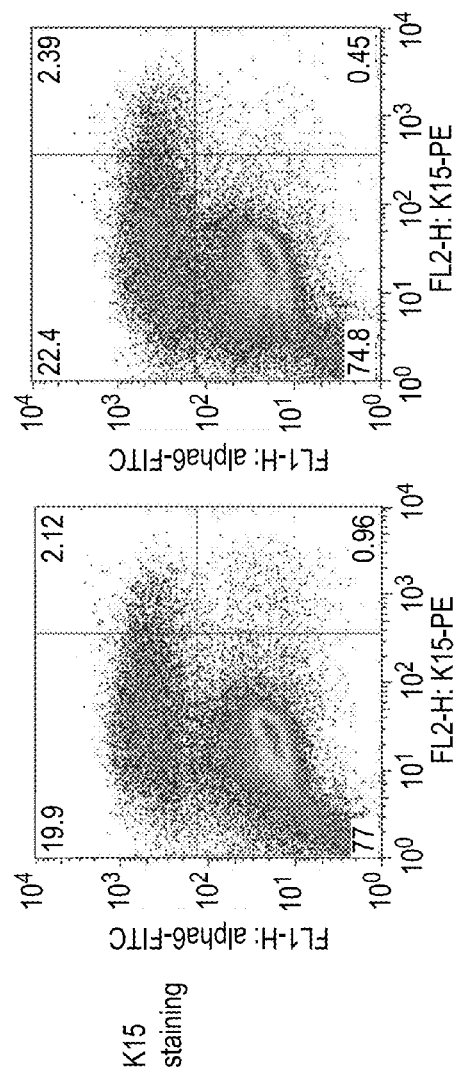
Figure 2C
K15 staining
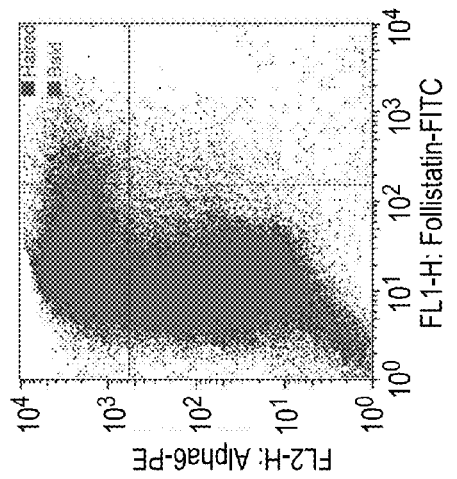
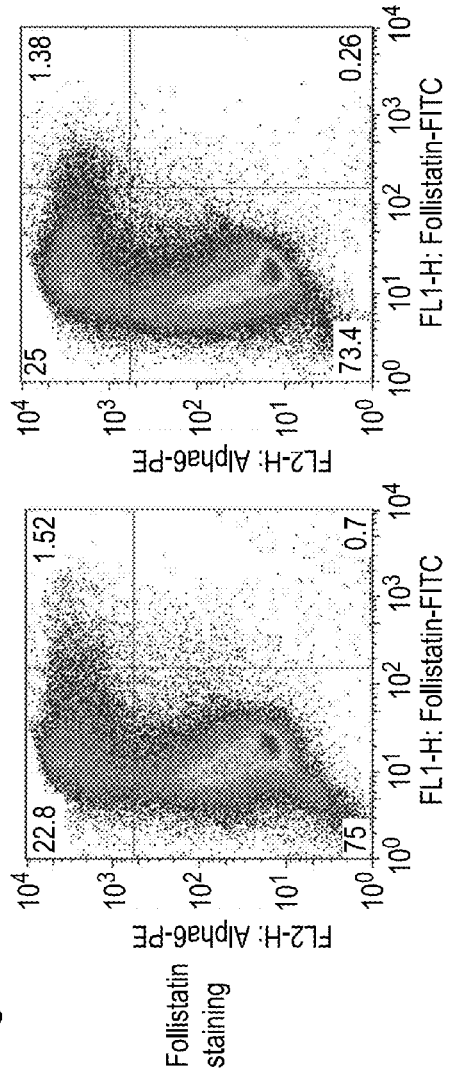
Figure 2D
Follistatin staining

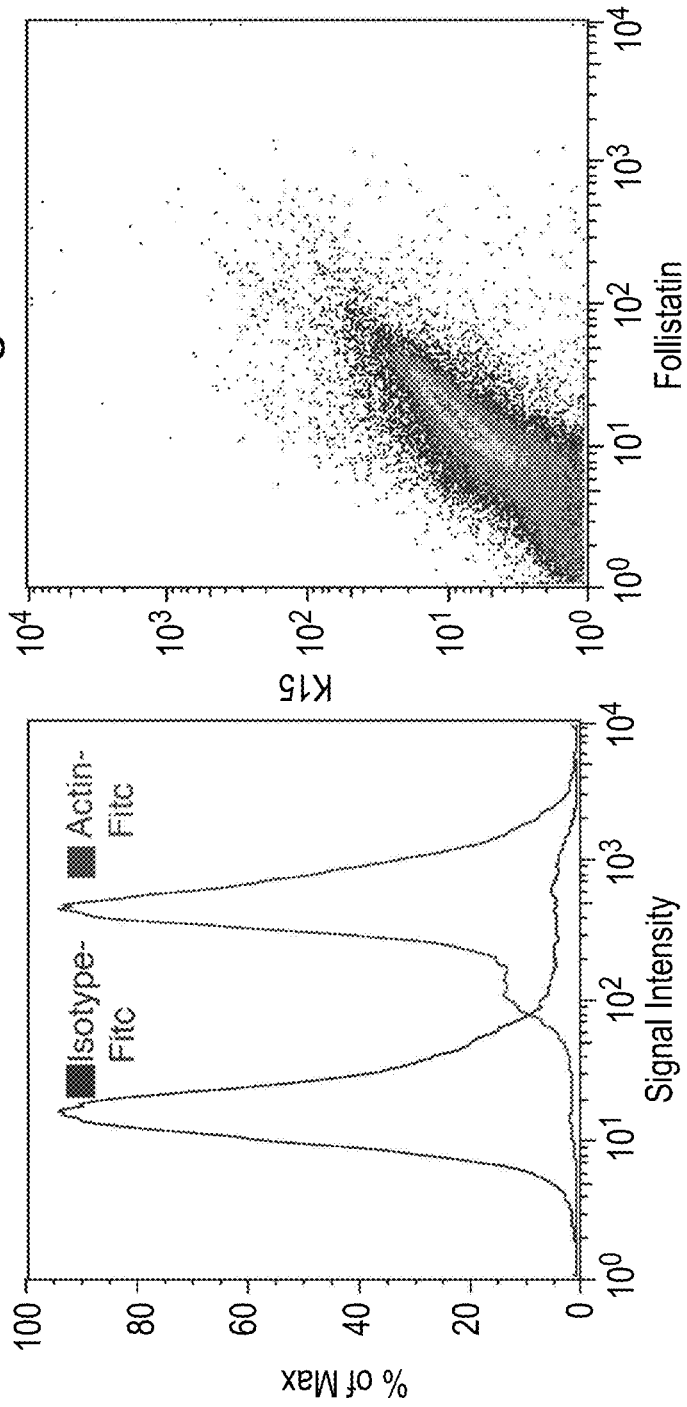

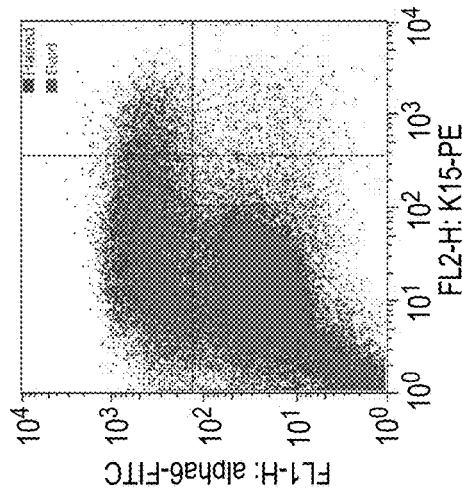
Figure 2G
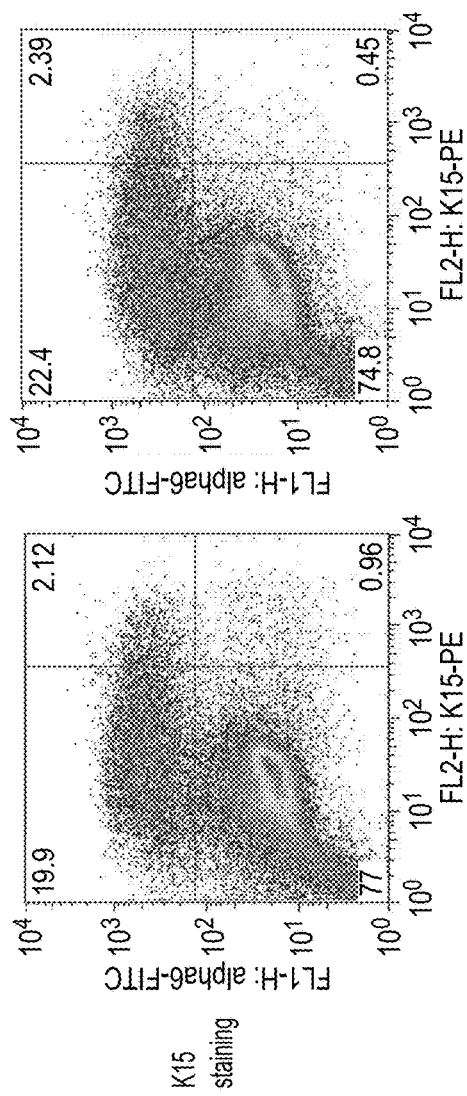
K15 staining
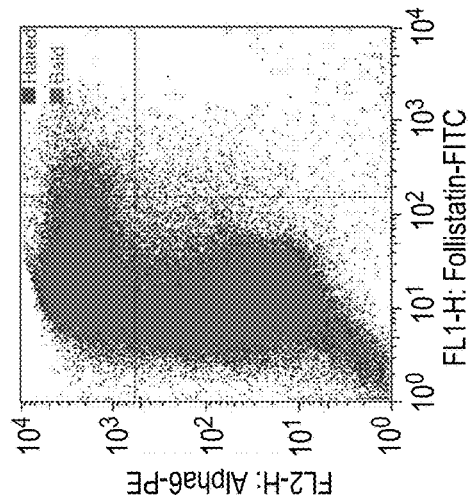
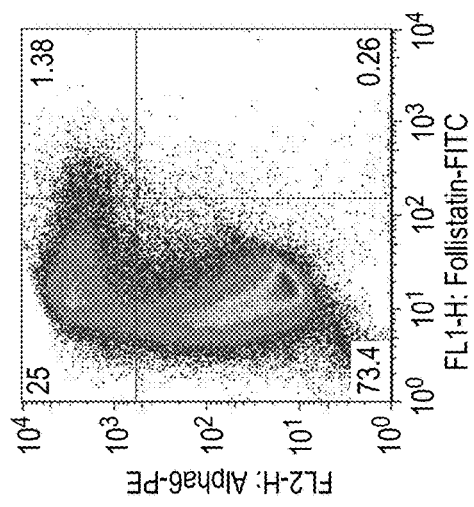
Figure 2H
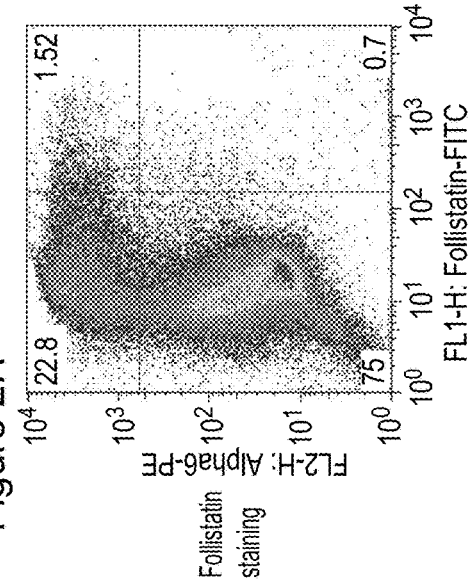
Follistatin staining

| Systematic | Common | SEQ ID No. | Genbank | Map | Gene Symbol Affymetrix | SwissProt Affymetrix | P Value | geo mean | fold |
|---|---|---|---|---|---|---|---|---|---|
| 220970_s_at | KRTAP2-4 | 1 | NM_030977 | 17q12-q21 | --- | --- | 0.000133 | 38.862 | 38.9 |
| 207787_at | KRTHA3B | 2 | NM_002279 | 17q12-21 | KRTHA3B | Q14525 | 0.000171 | 32.047 | 32.0 |
| 220972_s_at | KRTAP9-9 | 3 | NM_030975 | 17q12-q21 | --- | --- | 0.000827 | 31.065 | 31.1 |
| 206969_at | KRTHA4 | 4 | NM_021013 | 17q12-q21 | KRTHA4 | Q8IUT8 /// Q8N4W2 | 0.000184 | 30.642 | 30.6 |
| 208483_x_at | KRTHA3A | 5 | NM_004138 | 17q12-q21 | KRTHA3A | --- | 7.77E-05 | 27.729 | 27.7 |
| 220976_s_at | KRTAP1-1 | 6 | NM_030967 | 17q12-q21 | KRTAP1-1 | Q07627 /// Q96S60 /// Q96S67 | 0.000283 | 26.496 | 26.5 |
| 220978_at | KRTAP1-3 | 7 | NM_030966 | 17q12-q21 | KRTAP1-3 | Q8IUG1 /// Q9BYS2 | 0.000191 | 26.282 | 26.3 |
| 206677_at | KRTHA1 | 8 | NM_002277 | 17q12-q21 | KRTHA1 | Q15323 | 8.58E-05 | 19.731 | 19.7 |
| 221297_at | GPRC5D | 9 | NM_018854 | 12p13.3 | GPRC5D | Q7Z5J9 /// Q9NZD1 | 6.48E-05 | 19.553 | 19.6 |
| 213711_at | KRTHB1 | 10 | NM_002281 | 12q13 | KRTHB1 | Q14533 /// Q9BR74 | 9.72E-05 | 18.913 | 18.9 |
| 215189_at | KRTHB6 | 11 | X99142 | 12q13 | KRTHB6 | P78387 | 9.38E-05 | 18.279 | 18.3 |
| 206423_at | CDT6 | 12 | NM_021146 | 1p36.3-p36.2 | CDT6 | AAQ88668 /// O43827 | 0.000542 | 18.082 | 18.1 |
| 207457_s_at | LY6G6D | 13 | NM_021246 | 6p21.3 | LY6G6D | O95868 /// Q7Z5H2 /// Q8NDY2 /// Q9NZJ1 | 0.000375 | 17.780 | 17.8 |
| 216810_at | KRTAP4-9 | 14 | AJ406939 | 17q12-q21 | KRTAP4-7 | Q9BYR0 | 0.000701 | 17.235 | 17.2 |
| 216921_s_at | KRTHA5 | 15 | X90763 | 17q12-q21 | KRTHA5 | Q92764 | 0.000421 | 16.926 | 16.9 |
| 207669_at | KRTHB3 | 16 | NM_002282 | 12q13 | KRTHB3 | P78385 | 0.000482 | 16.844 | 16.8 |
| 206027_at | S100A3 | 17 | NM_002960 | 1q21 | S100A3 | AAP35601 /// P33764 | 6.47E-05 | 16.269 | 16.3 |
| 205713_s_at | COMP | 18 | NM_000095 | 19p13.1 | COMP | P49747 /// Q8N2R4 /// P49747 /// Q8N2R4 | 0.000452 | 15.658 | 15.7 |
| 207670_at | KRTHB5 | 19 | NM_002283 | 12q13 | KRTHB5 | P78386 | 0.000212 | 15.222 | 15.2 |
| 207146_at | KRTHA2 | 20 | NM_002278 | 17q12-q21 | KRTHA2 | Q14532 | 0.000126 | 10.173 | 10.2 |
| 220635_at | PSORS1C2 | 21 | NM_014069 | 6p21.3 | PSORS1C2 | Q9UIG4 | 0.000164 | 9.708 | 9.7 |
| 213880_at | GPR49 | 22 | AL524520 | 12q22-q23 | GPR49 | O75473 | 0.0017 | 6.836 | 6.8 |
| 206987_x_at | FGF18 | 23 | NM_003862 | 5q34 | FGF18 | AAQ89954 /// O76093 | 7.63E-05 | 5.950 | 6.0 |
| 211029_x_at | FGF18 | 24 | BC006245 | 5q34 | FGF18 | AAQ89954 /// O76093 | 0.000117 | 5.832 | 5.8 |

Figure 3A.1

| | | | | | | | |
|---|---|---|---|---|---|---|---|
| 207065_at | K6HF | 25 | NM_004693 | 12q13 | K6HF | O95678 | 2.49E-06 | 5.822 | 5.8 |
| 202833_s_at | SERPINA1 | 26 | NM_000295 | 14q32.1 | SERPINA1 | * see below | 0.00135 | 5.721 | 5.7 |
| 208092_s_at | CAD61914 /// DKFZP566A15 | 27 | CAD62306 /// P01009 /// Q13747 /// Q86U18 /// Q86U19 NM_030797 | 2p24.3 | DKFZP566A1 | Q9H0Q0 | 0.000952 | 5.124 | 5.1 |
| 213780_at | | 28 | N30878 | | --- | --- | 0.000135 | 5.097 | 5.1 |
| 213909_at | LRRC15 | 29 | AU147799 | 3q29 | CPN2 | P22792 /// Q86SU4 /// Q8N5V4 /// Q8TF66 | 9.59E-05 | 4.542 | 4.5 |
| 204687_at | DKFZP564O08 | 30 | NM_015393 | 4q13.3-q21.3 | DKFZP56400 | AAQ89137 /// Q96DV8 /// Q9Y4S1 | 0.000165 | 4.208 | 4.2 |
| 219932_at | SLC27A6 | 31 | NM_014031 | 5q31.1 | SLC27A6 | Q7Z6E6 /// Q86YF6 /// Q9Y2P4 | 0.0014 | 3.982 | 4.0 |
| 222351_at | PPP2R1B | 32 | AW009884 | 11q23.2 | PPP2R1B | P30154 /// Q8NHV8 | 3.98E-05 | 3.931 | 3.9 |
| 218935_at | EHD3 | 33 | NM_014600 | 2p21 | EHD3 | Q8N514 /// Q9NZN3 | 0.000485 | 3.872 | 3.9 |
| 203304_at | BAMBI | 34 | NM_012342 | 10p12.3-p11.2 | NMA | AAP35466 /// Q13145 | 0.00213 | 3.740 | 3.7 |
| 209800_at | KRT16 | 35 | AF061812 | 17q12-q21 | KRT16 | P08779 /// Q16195 | 0.000735 | 3.734 | 3.7 |
| 209343_at | EFHD1 | 36 | BC002449 | 2q37.1 | FLJ13612 | Q7Z2R5 /// Q8WYH2 /// Q9BUP0 Q8NAR2 /// Q9H6J0 /// Q9NXV0 | 0.000224 | 3.725 | 3.7 |
| 220272_at | BNC2 | 37 | NM_017637 | 9p22.2 | FLJ20043 | | 0.000253 | 3.634 | 3.6 |
| 212915_at | PDZRN3 | 38 | AL569804 | 3p14.1 | SEMACAP3 | BAC86547 /// Q8N2N7 /// Q96CC2 /// Q9NSQ2 /// Q9UPQ7 | 0.00175 | 3.512 | 3.5 |
| 221558_s_at | LEF1 | 39 | AF288571 | 4q23-q25 | LEF1 | Q9UJU2 | 0.00224 | 3.492 | 3.5 |
| 203921_at | CHST2 | 40 | NM_004267 | 3q24 | CHST2 | Q9UED5 /// Q9Y4C5 | 3.79E-05 | 3.479 | 3.5 |
| 205290_s_at | BMP2 | 41 | NM_001200 | 20p12 | BMP2 | P12643 | 0.000335 | 3.479 | 3.5 |
| 202376_at | SERPINA3 | 42 | NM_001085 | 14q32.1 | SERPINA3 | P01011 /// P05154 /// Q8N177 /// Q96DW8 /// Q9UNU9 | 0.00343 | 3.470 | 3.5 |
| 210393_at | GPR49 | 43 | AF062006 | 12q22-q23 | GPR49 | O75473 | 0.00165 | 3.341 | 3.3 |
| 37892_at | COL11A1 | 44 | J04177 | 1p21 | COL11A1 | P12107 | 0.00296 | 3.309 | 3.3 |
| 206140_at | LHX2 | 45 | NM_004789 | 9q33-q34.1 | LHX2 | P50458 | 0.00129 | 3.239 | 3.2 |
| 201109_s_at | THBS1 | 46 | AV726673 | 15q15 | THBS1 | P07996 | 0.00142 | 3.192 | 3.2 |
| 202886_s_at | PPP2R1B | 47 | M65254 | 11q23.2 | PPP2R1B | P30154 /// Q8NHV8 | 0.000276 | 2.969 | 3.0 |
| 205374_at | SLN | 48 | NM_003063 | 11q22-q23 | SLN | O00631 /// Q9B571 | 0.00195 | 2.945 | 2.9 |

Figure 3A.2

| | | | | | | |
|---|---|---|---|---|---|---|
| 219250_s_at | FLRT3 | 49 | NM_013281 | 20p11 | FLRT3 | BAC11284 /// Q8NC95 /// Q9NZU0 | 0.000267 | 2.879 | 2.9 |
| 219832_s_at | HOXC13 | 50 | NM_017410 | 12q13.3 | HOXC13 | AAP88910 /// CAA67995 /// P31276 | 0.00223 | 2.859 | 2.9 |
| 202883_s_at | PPP2R1B | 51 | T79584 | 11q23.2 | PPP2R1B | P30154 /// Q8NHV8 | 0.00121 | 2.819 | 2.8 |
| 209921_at | SLC7A11 | 52 | AB040875 | 4q28-q32 | SLC7A11 | Q9BYH2 /// Q9UPY5 | 0.000634 | 2.813 | 2.8 |
| 211071_s_at | AF1Q | 53 | BC006471 | 1q21 | AF1Q | AAP35445 /// Q13015 | 0.00162 | 2.791 | 2.8 |
| 216603_at | SLC7A8 | 54 | AL365343 | 14q11.2 | SLC7A8 | Q7Z4Z3 /// Q7Z4Z5 /// Q86U05 /// Q8N424 /// Q9UH15 | 0.00189 | 2.749 | 2.7 |
| 211219_s_at | LHX2 | 55 | U11701 | 9q33-q34.1 | LHX2 | P50458 | 4.82E-05 | 2.748 | 2.7 |
| 202016_at | MEST | 56 | NM_002402 | 7q32 | MEST | O14973 /// O15007 /// Q92571 | 0.00104 | 2.645 | 2.6 |
| 215034_s_at | TM4SF1 | 57 | AI189753 | 3q21-q25 | TM4SF1 | P30408 /// Q8NE91 | 0.00234 | 2.619 | 2.6 |
| 202884_s_at | PPP2R1B | 58 | NM_002716 | 11q23.2 | PPP2R1B | P30154 /// Q8NHV8 | 0.00128 | 2.591 | 2.6 |
| 206315_at | CRLF1 | 59 | NM_004750 | 19p12 | CRLF1 | AAQ88658 /// O75462 /// Q9UHH5 | 0.00217 | 2.559 | 2.6 |
| 209286_at | CDC42EP3 | 60 | AI754416 | 2p21 | CDC42EP3 | O95353 /// Q9UQ10 | 0.000419 | 2.550 | 2.6 |
| 203980_at | FABP4 | 61 | NM_001442 | 8q21 | FABP4 | AAP35455 /// P15090 | 0.00137 | 2.541 | 2.5 |
| 210319_x_at | MSX2 | 62 | D89377 | 5q34-q35 | MSX2 | AAP88816 /// P35548 | 0.00247 | 2.531 | 2.5 |
| 204351_at | S100P | 63 | NM_005980 | 4p16 | S100P | AAO41114 /// AAP35953 /// P25815 | 0.0011 | 2.495 | 2.5 |
| 212154_at | SDC2 | 64 | AI380298 | 8q22-q23 | SDC2 | AAH30133 /// P34741 | 0.000882 | 2.492 | 2.5 |
| 212391_at | BASP1 | 65 | NM_006317 | 5p15.1-p14 | BASP1 | P80723 /// Q9BWA5 | 0.000112 | 2.482 | 2.5 |
| 214036_at | | 66 | BE464799 | | | --- | 0.00346 | 2.392 | 2.4 |
| 209288_s_at | CDC42EP3 | 67 | AL136842 | 2p21 | CDC42EP3 | O95353 /// Q9UQ10 /// AAQ88717 /// Q86SN3 /// Q8N1Y2 | 0.00243 | 2.378 | 2.4 |
| 213100_at | UNC5B | 68 | AA127885 | 10q22.2 | UNC5B | /// Q9H9F3 | 0.000421 | 2.367 | 2.4 |

Figure 3A.3

| | | | | | | |
|---|---|---|---|---|---|---|
| 215785_s_at | CYFIP2 | 69:AL161999 | 5q33.3 | Q14650 /// Q96F07 /// Q9NSN1 /// Q9NTK4 /// Q9ULQ2 /// Q9UN29 | 2.45E-05 | 2.352 | 2.4 |
| 200906_s_at | KIAA0992 | 70:AK025843 | 4q32.3 | * see below | 0.000308 | 2.328 | 2.3 |
| | AAH13867 /// Q7Z3W0 /// Q86WE8 /// Q8N1M2 /// Q8WX93 /// Q9UQF5 /// Q9Y216 /// Q9Y3E9 | | | | | | |
| 205932_s_at | MSX1 | 71:NM_002448 | 4p16.3-p16.1 | AAH21285 /// P28360 | 0.000967 | 2.286 | 2.3 |
| 205289_at | BMP2 | 72:AA583044 | 20p12 | P12643 | 0.000366 | 2.233 | 2.2 |
| 216092_s_at | SLC7A8 | 73:AL365347 | 14q11.2 | Q7Z4Z3 /// Q7Z4Z5 /// Q86U05 /// Q8N424 /// Q9UHI5 | 7.62E-05 | 2.200 | 2.2 |
| 210074_at | CTSL2 | 74:AF070448 | 9q22.2 | AAQ89004 /// O60911 | 0.000872 | 2.195 | 2.2 |
| 213556_at | | 75:BE673445 | 19q13.32 | | 0.00166 | 2.154 | 2.2 |
| 203797_at | VSNL1 | 76:AF039555 | 2p24.3 | P28677 | 3.68E-05 | 2.134 | 2.1 |
| 219229_at | SLCO3A1 | 77:NM_013272 | 15q26 | Q9UIG8 | 0.000184 | 2.105 | 2.1 |
| 202166_s_at | PPP1R2 | 78:NM_006241 | 3q29 | P41236 | 6.52E-05 | 2.092 | 2.1 |
| 204256_at | ELOVL6 | 79:NM_024090 | 4q25 | Q8NCD1 /// Q9HS14 | 0.00209 | 2.067 | 2.1 |
| 202693_s_at | STK17A | 80:AW194730 | 7p12-p14 | Q8IVC8 /// Q9UEE5 | 0.000351 | 2.043 | 2.0 |
| 205472_s_at | DACH1 | 81:NM_004392 | 13q22 | AAH21219 /// O75523 /// Q9UMH4 | 0.00153 | 2.029 | 2.0 |
| 203798_s_at | VSNL1 | 82:NM_003385 | 2p24.3 | P28677 | 0.00214 | 2.027 | 2.0 |
| 202363_at | SPOCK | 83:AF231124 | 5q31 | Q08629 /// Q8N630 | 0.00147 | 2.007 | 2.0 |
| 200730_s_at | PTP4A1 | 84:BF576710 | 6q12 | O00648 /// Q93096 | 0.00346 | 2.002 | 2.0 |
| 204141_at | TUBB | 85:NM_001069 | 6p25 | Q13885 /// Q8IWR2 | 4.89E-05 | 1.994 | 2.0 |
| 202436_s_at | CYP1B1 | 86:AU144855 | 2p21 | Q16678 | 0.00296 | 1.969 | 2.0 |
| 208637_x_at | ACTN1 | 87:BC003576 | 14q24 | P12814 /// Q86TX4 /// Q9BTN1 | 0.00105 | 1.961 | 2.0 |
| 204682_at | LTBP2 | 88:NM_000428 | 14q24 | Q14767 | 0.00102 | 1.938 | 1.9 |
| 203574_at | NFIL3 | 89:NM_005384 | 9q22 | Q14211 /// Q16649 /// Q96HS0 | 0.00106 | 1.935 | 1.9 |
| 214104_at | GPR161 | 90:AI703188 | 1q23.3 | O75963 /// Q8N247 /// Q8N6U8 | 0.00245 | 1.901 | 1.9 |
| 201105_at | LGALS1 | 91:NM_002305 | 22q13.1 | AAP35421 /// BAC77389 /// P09382 /// Q15954 | 4.11E-06 | 1.866 | 1.9 |
| 209126_x_at | KRT6A | 92:L42612 | 12q12-q13 | P48669 | 0.000477 | 1.838 | 1.8 |
| 213135_at | TIAM1 | 93:U90902 | 21q22.1 | Q13009 | 0.00269 | 1.819 | 1.8 |

Figure 3A.4

| | | | | | | | |
|---|---|---|---|---|---|---|---|
| 200907_s_at | KIAA0992 | | AU157932 | 4q32.3 | KIAA0992 | * see below | 3.96E-05 | 1.814 | 1.8 |
| | AAH13867 /// Q7Z3W0 /// Q86WE8 /// Q8N1M2 /// Q8WX93 /// Q9UQF5 /// Q9Y2J6 /// Q9Y3E9 | | | | | | | |
| 217933_s_at | LAP3 | 95 | NM_015907 | 4p15.33 | LAP3 | AAH06199 /// P28838 | 0.00326 | 1.813 | 1.8 |
| 217897_at | FXYD6 | 96 | NM_022003 | 11q23.3 | FXYD6 | AAP35363 /// AAQ89335 /// Q9H0Q3 | 8.64E-05 | 1.774 | 1.8 |
| 201266_at | TXNRD1 | 97 | NM_003330 | 12q23-q24.1 | TXNRD1 | AAH18122 /// BAC87474 /// Q16881 /// Q99475 /// Q9UES8 | 0.00023 | 1.751 | 1.8 |
| 215253_s_at | DSCR1 | 98 | AL049369 | 21q22.12 | DSCR1 | AAP36027 /// P53805 /// Q7Z555 /// Q9H2A1 | 0.000526 | 1.750 | 1.8 |
| 201286_at | SDC1 | 99 | Z48199 | 2p24.1 | SDC1 | CAD80245 /// P18827 | 0.00209 | 1.741 | 1.7 |
| 209772_s_at | CD24 | 100 | X69397 | 6q21 | CD24 | AAP36068 /// P25063 | 0.000311 | 1.733 | 1.7 |
| 221881_s_at | CLIC4 | 101 | AI638420 | 1p36.11 | CLIC4 | Q9NVF8 /// Q9Y696 | 0.000518 | 1.713 | 1.7 |
| 201616_s_at | CALD1 | 102 | AL577531 | 7q33 | CALD1 | AAH14035 /// AAH61926 /// Q05682 /// Q7Z2Y9 /// Q8N76 | 0.000286 | 1.708 | 1.7 |
| 209283_at | CRYAB | 103 | AF007162 | 11q22.3-q23.1 | CRYAB | AAP35416 /// P02511 | 0.000844 | 1.695 | 1.7 |
| 37408_at | MRC2 | 104 | AB014609 | 17q24.1 | MRC2 | BAA31684 /// BAC86276 /// O00572 /// Q9UBG0 /// Q9Y5P9 | 0.000376 | 1.665 | 1.7 |
| 200897_s_at | KIAA0992 | 105 | NM_016081 | 4q32.3 | KIAA0992 | * see below | 0.00163 | 1.642 | 1.6 |
| | AAH13867 /// Q7Z3W0 /// Q86WE8 /// Q8N1M2 /// Q8WX93 /// Q9UQF5 /// Q9Y2J6 /// Q9Y3E9 | | | | | | | |
| 208636_at | ACTN1 | 106 | AI082078 | 14q24.1-q24.2 | ACTN1 | P12814 /// Q86TX4 /// Q9BTN1 | 0.000515 | 1.641 | 1.6 |
| 208708_x_at | EIF5 | 107 | AL080102 | 14q32.33 | EIF5 | P55010 | 0.00217 | 1.611 | 1.6 |
| 205157_s_at | KRT17 | 108 | NM_000422 | 17q12-q21 | KRT17 | Q04695 /// Q14666 /// Q8N1P6 | 0.00194 | 1.601 | 1.6 |
| 204029_at | CELSR2 | 109 | NM_001408 | 1p21 | CELSR2 | BAC86821 /// BAC87111 /// Q9HCU4 | 0.00309 | 1.597 | 1.6 |
| 200644_at | MLP | 110 | NM_023009 | 1p34.3 | MLP | CAD28462 /// P49006 | 0.00288 | 1.575 | 1.6 |
| 210987_x_at | TPM1 | 111 | M19267 | 15q22.1 | --- | --- | 0.00305 | 1.574 | 1.6 |

Figure 3A.5

| | | | | | | |
|---|---|---|---|---|---|---|
| 201397_at | PHGDH | 112 | NM_006623 | 1p12 | PHGDH | O43175 /// Q9UMY2 /// Q9UMY3 | 0.0032 | 1.568 | 1.6 |
| 202936_s_at | SOX9 | 113 | NM_000346 | 17q24.3-q25.1 | SOX9 | AAP35521 /// P48436 | 0.00207 | 1.566 | 1.6 |
| 41856_at | UNC5B | 114 | AL049370 | 10q22.2 | UNC5B | AAQ88717 /// Q86SN3 /// Q8N1Y2 /// Q9H9F3 /// Q13135 /// Q13136 /// Q14567 /// Q8N4I2 | 0.00188 | 1.566 | 1.6 |
| 202066_at | PPFIA1 | 115 | AA195259 | 11q13.2 | PPFIA1 | P04792 /// Q96C20 /// Q96EI7 | 0.00272 | 1.557 | 1.6 |
| 201841_s_at | HSPB1 | 116 | NM_001540 | 7q11.23 | HSPB1 | P04792 /// Q96C20 /// Q96EI7 | 0.00164 | 1.552 | 1.6 |
| 209099_x_at | JAG1 | 117 | U73936 | 20p12.1-p11.2 | JAG1 | P78504 /// Q99740 | 0.00228 | 1.546 | 1.5 |
| 214590_s_at | UBE2D1 | 118 | AL545760 | 10q11.2-q21 | UBE2D1 | AAP35690 /// CAC82177 /// P51668 | 0.000816 | 1.520 | 1.5 |
| 205125_at | PLCD1 | 119 | NM_006225 | 3p22-p21.3 | PLCD1 | AAH50382 /// P51178 /// Q86VN8 | 0.00231 | 1.515 | 1.5 |
| 203585_at | ZNF185 | 120 | NM_007150 | xq28 | ZNF185 | CAE45970 /// O15231 /// Q7Z3Q8 /// Q8N1R8 | 0.00242 | 1.495 | 1.5 |
| 203367_at | DUSP14 | 121 | NM_007026 | 17q12 | DUSP14 | O95147 | 0.00312 | 1.479 | 1.5 |
| 204255_s_at | VDR | 122 | AA772285 | 12q12-q14 | VDR | P11473 | 0.00043 | 1.477 | 1.5 |
| 211383_s_at | WDR37 | 123 | AL136827 | 10p15.3 | KIAA0982 | BAA76826 /// Q8WVG2 /// Q9P142 /// Q9Y2I8 | 0.00231 | 1.470 | 1.5 |
| 212426_s_at | YWHAQ | 124 | BF033313 | 2p25.2-p25.1 | YWHAQ | P27348 /// Q9UP48 | 0.00154 | 1.443 | 1.4 |
| 213072_at | LOC157542 | 125 | AI928387 | 8q24.3 | MGC13010 | AAH04544 /// Q9BSF6 /// Q9BSU6 | 0.00264 | 1.443 | 1.4 |
| 204761_at | USP6NL | 126 | NM_014688 | 10p13 | USP6NL | BAA02807 /// Q8ND29 /// Q92738 /// Q96FW8 | 0.00157 | 1.441 | 1.4 |
| 202949_s_at | FHL2 | 127 | NM_001450 | 2q12-q14 | FHL2 | AAH12742 /// AAP35606 /// Q14192 | 0.00343 | 1.438 | 1.4 |
| 210986_s_at | TPM1 | 128 | Z24727 | 15q22.1 | TPM1 | * see below | 0.00132 | 1.432 | 1.4 |
| | BAC85248 /// O15513 /// P09493 /// Q07414 /// Q15657 /// Q7Z6L8 /// Q86W64 /// Q8NAJ1 /// Q8TCG4 /// Q9Y427 | | | | | | | | |
| 214749_s_at | FLJ20811 | 129 | AK000818 | xq21.33-q22.3 | FLJ20811 | AAH07677 /// Q9NWJ3 | 0.00226 | 1.427 | 1.4 |
| 200924_s_at | SLC3A2 | 130 | NM_002394 | 11q13 | SLC3A2 | P08195 | 0.00244 | 1.424 | 1.4 |

Figure 3A.6

| | | | | | | | | | |
|---|---|---|---|---|---|---|---|---|---|
| 202570_s_at | DLGAP4 | 131 | BF346592 | 20q11.23 | DAP4 | BAA76808 /// BAC86151 /// Q9Y2H0 | 0.00202 | 1.412 | 1.4 |
| 209859_at | TRIM9 | 132 | AF220036 | 14q22.1 | TRIM9 | AAH63872 /// Q9C026 | 0.00326 | 1.408 | 1.4 |
| 213134_x_at | BTG3 | 133 | AI765445 | 21q21.1-q21.2 | BTG3 | AAP35940 /// Q14201 | 0.000294 | 1.401 | 1.4 |
| 208949_s_at | LGALS3 | 134 | BC001120 | 14q21-q22 | LGALS3 | CAE46042 /// P17931 /// Q86TY5 /// Q9H2I5 /// Q9HZJ6 | 0.00337 | 1.371 | 1.4 |
| 202345_s_at | FABP5 | 135 | NM_001444 | 8q21.13 | FABP5 | AAP36117 /// Q01469 | 0.000698 | 1.364 | 1.4 |
| 214004_s_at | KIAA0121 | 136 | AI806207 | 3p25.2 | KIAA0121 | AAH01514 /// BAC85375 /// Q14135 /// Q9BQ78 | 0.00237 | 1.360 | 1.4 |
| 209344_at | TPM4 | 137 | BC002827 | 19p13.1 | TPM4 | P07226 | 0.002 | 1.354 | 1.4 |
| 212365_at | MYO1B | 138 | BF215996 | 2q12-q34 | MYO1B | O43795 /// Q14777 /// Q7Z6L5 /// Q9HA08 | 0.00164 | 1.341 | 1.3 |
| 205372_at | PLAG1 | 139 | NM_002655 | 8q12 | PLAG1 | Q9Y4L2 | 0.00108 | 1.311 | 1.3 |
| 204361_s_at | SCAP2 | 140 | AB014486 | 7p21-p15 | SCAP2 | O75563 /// Q9UBZ3 /// Q9UED8 | 0.00149 | 1.311 | 1.3 |
| 200824_at | GSTP1 | 141 | NM_000852 | 11q13 | GSTP1 | P09211 | 0.00287 | 1.305 | 1.3 |
| 209427_at | SMTN | 142 | AF064238 | 22q12.2 | SMTN | * see below | 0.00289 | 1.292 | 1.3 |
| | P53814 /// Q8N4H8 /// Q12955 /// Q7Z3G4 /// Q8WWW1 /// Q8WWW2 /// Q8NAK2 /// Q96EQ7 /// Q9H0P5 | | | | | | | | |
| 200839_s_at | CTSB | 143 | NM_001908 | 8p22 | CTSB | CAA77178 /// P07858 | 0.00183 | 1.283 | 1.3 |
| 36564_at | IBRDC3 | 144 | W27419 | 1p34.3 | FLJ90005 | AAH20595 /// AAH62374 /// Q8N2S8 /// Q8WUF3 | 0.00192 | 1.279 | 1.3 |
| 203423_at | RBP1 | 145 | NM_002899 | 3q23 | RBP1 | P09455 | 0.00116 | 1.265 | 1.3 |
| 210493_s_at | KIAA0626 | 146 | BC001279 | 4q32.3 | KIAA0626 | Q9BVE1 | 0.00297 | 1.257 | 1.3 |
| 209442_x_at | ANK3 | 147 | AL136710 | 10q21 | ANK3 | * see below | 0.00298 | 1.247 | 1.2 |
| | BAC86721 /// Q12955 /// Q7Z3G4 /// Q8WWW1 /// Q8NAK2 /// Q9H0P5 | | | | | | | | |
| 201820_at | KRT5 | 148 | NM_000424 | 12q12-q13 | KRT5 | AAH42132 /// AAQ81588 /// P13647 | 0.00327 | 1.244 | 1.2 |
| 205732_s_at | NCOA2 | 149 | NM_006540 | 8q13.2 | NCOA2 | Q15596 | 0.000564 | 1.238 | 1.2 |
| 38340_at | HIP1R | 150 | AB014555 | 12q24 | HIP1R | BAC85372 /// O75146 | 0.0015 | 1.223 | 1.2 |

Figure 3A.7

| | | | | | | | |
|---|---|---|---|---|---|---|---|
| 201485_s_at | RCN2 | 151 | BC004892 | 15q23 | RCN2 | AAP88792 /// Q14257 | 0.0012 | 1.220 | 1.2 |
| 218032_at | SNN | 152 | AF070673 | 16p13 | SNN | O75324 /// O75324 | 0.000564 | 1.206 | 1.2 |
| 214116_at | BTD | 153 | AI767414 | 3p25 | BTD | P43251 | 6.68E-05 | 1.204 | 1.2 |
| 201131_s_at | CDH1 | 154 | NM_004360 | 16q22.1 | CDH1 | P12830 /// Q9UI17 /// Q9UI18 | 0.000511 | 1.196 | 1.2 |
| 211995_x_at | ACTG1 | 155 | AL567820 | 17q25 | ACTG1 | * see below | 0.00297 | 1.191 | 1.2 |
| | AAH04223 /// P02571 /// Q8WVW5 /// Q96DE1 /// Q9BTD2 | | | | | | | | |
| 220768_s_at | CSNK1G3 | 156 | NM_004384 | 5q23 | CSNK1G3 | Q86W27 /// Q9Y6M4 | 0.000318 | 1.190 | 1.2 |
| 213811_x_at | TCF3 | 157 | AW062341 | 19p13.3 | TCF3 | P15923 /// Q7Z5L6 | 0.000844 | 1.185 | 1.2 |
| 209351_at | KRT14 | 158 | BC002690 | 17q12-q21 | KRT14 | AAP35850 /// P02533 /// Q13092 | 0.00342 | 1.184 | 1.2 |
| 212363_x_at | ACTG1 | 159 | AU145192 | 17q25 | ACTG1 | * see below | 0.00191 | 1.163 | 1.2 |
| | AAH04223 /// P02571 /// Q8WVW5 /// Q96DE1 /// Q9BTD2 | | | | | | | | |
| 209014_at | MAGED1 | 160 | AF217963 | xp11.23 | MAGED1 | AAQ14483 /// Q8TEN0 /// Q9Y5V3 | 0.00274 | 1.158 | 1.2 |
| 202150_s_at | NEDD9 | 161 | U64317 | 6p25-p24 | NEDD9 | AAH50740 /// Q14511 | 0.00254 | 1.156 | 1.2 |
| 204131_s_at | FOXO3A | 162 | N25732 | 6q21 | --- | --- | 0.00102 | 1.150 | 1.1 |
| 212971_at | CARS | 163 | AI769685 | 11p15.5 | CARS | AAP88915 /// BAC86184 /// P49589 | 0.00226 | 1.150 | 1.1 |
| 212741_at | MAOA | 164 | AA923354 | xp11.4-p11.3 | MAOA | AAP35297 /// P21397 | 0.000698 | 1.144 | 1.1 |
| AFFX-HSAC07/ | ACTB | 165 | AFFX-HSAC07/ | 7p15-p12 | ACTB | P02570 /// Q96B34 /// Q96HG5 /// Q9UE89 /// AAP35405 /// BAC85806 /// | 0.00119 | 1.124 | 1.1 |
| 209408_at | KIF2C | 166 | U63743 | 1p34.1 | KIF2C | Q8N5N1 /// Q99661 | 0.00328 | 1.081 | 1.1 |
| 205745_x_at | ADAM17 | 167 | NM_003183 | 2p25 | ADAM17 | P78536 | 0.000395 | 1.080 | 1.1 |
| 210160_at | PAFAH1B2 | 168 | BC000398 | 11q23 | PAFAH1B2 | Q29459 /// Q9BUZ1 | 0.000322 | 1.057 | 1.1 |
| 202706_s_at | UMPS | 169 | D86227 | 3q13 | UMPS | P11172 | 0.00263 | 1.051 | 1.1 |
| 212087_s_at | ERAL1 | 170 | AL562733 | 17q11.2 | ERAL1 | O75616 /// Q96LE2 /// Q96TC0 | 0.00206 | 0.921 | -1.1 |
| 214011_s_at | HSPC111 | 171 | BE314601 | 5q35.3 | HSPC111 | AAH32424 /// Q8IXL5 /// Q9P0T8 /// Q9Y3C1 | 0.00227 | 0.885 | -1.1 |
| 208959_s_at | TXNDC4 | 172 | BC005374 | 9q31.1 | TXNDC4 | AAQ89407 /// Q9BS26 | 0.0023 | 0.883 | -1.1 |

Figure 3A.8

| | | | | | | | |
|---|---|---|---|---|---|---|---|
| 203405_at | DSCR2 | 173 | NM_003720 | 21q22.3 | DSCR2 | AAR25628 /// O95456 | 0.000497 | 0.880 | -1.1 |
| 214527_s_at | PQBP1 | 174 | AB041836 | xp11.23 | PQBP1 | O60828 /// Q9GZP2 /// Q9GZU4 /// Q9GZZ4 | 0.00151 | 0.877 | -1.1 |
| 219770_at | FLJ11753 | 175 | NM_024659 | 2q22.3-q23.1 | FLJ11753 | AAH17741 /// AAH61699 /// Q9HAE5 | 0.00269 | 0.862 | -1.2 |
| 213136_at | PTPN2 | 176 | AI828880 | 18p11.3-p11.2 | PTPN2 | P17706 /// Q96AU5 | 0.00289 | 0.852 | -1.2 |
| 203501_at | PGCP | 177 | NM_006102 | 8q22.2 | PGCP | | 0.000169 | 0.851 | -1.2 |
| | Q8NBZ1 /// Q9UNM8 /// Q9Y5X6 /// Q8NBZ1 /// Q9UNM8 /// Q9Y5X6 /// Q9Y646 | | | | | Q8NAL4 /// Q8WWA1 /// | | | |
| 219503_s_at | FLJ11036 | 178 | NM_018306 | 3p25.2 | FLJ11036 | Q9NU24 | 0.00328 | 0.841 | -1.2 |
| 218992_at | C9orf46 | 179 | NM_018465 | 9p24.1 | C9orf46 | Q9HBL7 /// Q9NZ44 | 0.00227 | 0.840 | -1.2 |
| 220052_s_at | TINF2 | 180 | NM_012461 | 14q11.2 | TINF2 | Q86TZ8 /// Q9BSI4 | 0.000849 | 0.830 | -1.2 |
| 215460_x_at | BRD1 | 181 | AL080149 | 22q13.33 | BRD1 | O95696 /// Q86X06 /// Q9Y4Q3 | 0.00236 | 0.820 | -1.2 |
| 203505_at | ABCA1 | 182 | AF285167 | 9q31.1 | ABCA1 | | 0.00285 | 0.802 | -1.2 |
| | BAC85435 /// O95477 /// Q9H7T8 /// Q9NP93 /// Q9NS76 | | | | | | | | |
| 207543_s_at | P4HA1 | 183 | NM_000917 | 10q21.3-q23.1 | P4HA1 | P13674 | 0.00301 | 0.801 | -1.2 |
| 218418_s_at | ANKRD25 | 184 | NM_015493 | 19p13.2 | KIAA1518 | Q9H8S4 /// Q9NUP0 /// Q9NXX5 /// Q9UFS0 | 0.00311 | 0.799 | -1.3 |
| 204440_at | CD83 | 185 | NM_004233 | 6p23 | CD83 | Q01151 | 0.00112 | 0.796 | -1.3 |
| 220942_x_at | E2IG5 | 186 | NM_014367 | 3q21.1 | E2IG5 | Q96A26 /// Q9H2P1 /// Q9H3G4 /// Q9NRN6 /// Q9UJX8 | 0.000619 | 0.792 | -1.3 |
| 218280_x_at | HIST2H2AA | 187 | NM_003516 | 1q21.3 | HIST2H2AA | --- | 0.000763 | 0.791 | -1.3 |
| 208717_at | OXA1L | 188 | BC001669 | 14q11.2 | OXA1L | AAH01669 /// Q15070 | 0.00353 | 0.785 | -1.3 |
| 212706_at | RASA4 | 189 | AB011110 | 7q22-q31.1 | POLR2J2 | O43374 /// Q8TDE6 /// Q9H1A7 /// Q9H1A8 | 0.000427 | 0.779 | -1.3 |
| 218119_at | TIMM23 | 190 | NM_006327 | 10q11.21-q11. | TIMM23 | AAH62707 /// AAR14723 /// O14925 | 0.00126 | 0.768 | -1.3 |
| 202686_s_at | AXL | 191 | NM_021913 | 19q13.1 | AXL | P30530 /// Q8N5L2 | 0.00282 | 0.768 | -1.3 |
| 206910_x_at | HFL3 | 192 | NM_005666 | 1q31-q32.1 | HFL3 | P36980 | 1.13E-05 | 0.758 | -1.3 |

Figure 3A.9

| | | | | | | | | |
|---|---|---|---|---|---|---|---|---|
| 201190_s_at | PITPN | 193:H15647 | | PITPN | Q00169 | 0.0014 | 0.732 | -1.4 |
| 200629_at | WARS | 194:NM_004184 | 17p13.3 | WARS | CAD62335 /// P23381 | 0.00295 | 0.725 | -1.4 |
| 203913_s_at | HPGD | 195:AL574184 | 14q32.31 | HPGD | O00749 /// P15428 /// Q12998 | 0.0027 | 0.724 | -1.4 |
| 202368_s_at | TRAM2 | 196:AI986461 | 4q34-q35 | TRAM2 | BAA06540 /// Q15035 | 0.00104 | 0.719 | -1.4 |
| 216231_s_at | B2M | 197:AW188940 | 6p21.1-p12 | B2M | AAO20842 /// P01884 /// Q16446 | 0.00208 | 0.718 | -1.4 |
| 210514_x_at | HLA-C | 198:AF226990 | 15q21-q22.2 | HLA-G | * see below | 0.00276 | 0.718 | -1.4 |
| 210514_x_at | AAQ83724 /// O02923 /// O02924 /// O78135 /// O78136 /// P17693 /// Q29897 /// Q30182 /// Q31611 /// Q8WLS1 /// Q95HM6 | | 6p21.3 | | O02925 /// O02926 /// O02927 /// O02928 /// O02929 /// O78131 /// O78132 | | | |
| 210514_x_at | O78133 /// O78134 /// Q9MYA2 /// Q9UM45 | | | | | | | |
| 221485_at | B4GALT5 | 199:AL035683 | 20q13.1-q13.2 | B4GALT5 | O43286 /// Q8WZ36 | 0.00156 | 0.715 | -1.4 |
| 202459_s_at | LPIN2 | 200:U55968 | 18p11.31 | LPIN2 | BAA13380 /// Q92539 | 4.91E-05 | 0.693 | -1.4 |
| 202295_s_at | CTSH | 201:NM_004390 | 15q24-q25 | CTSH | CAA77179 /// P09668 /// Q96NY6 | 0.000227 | 0.691 | -1.4 |
| 213832_at | | 202:AA530995 | | | | 0.000781 | 0.690 | -1.5 |
| 204083_s_at | TPM2 | 203:NM_003289 | 9p13.2-p13.1 | TPM2 | P07951 | 0.00274 | 0.676 | -1.5 |
| 209728_at | HLA-DRB4 | 204:BC005312 | 6p21.3 | HLA-DRB3 | * see addendum /// AAP35886 /// | 0.000475 | 0.669 | -1.5 |
| 202283_at | SERPINF1 | 205:NM_002615 | 17p13.1 | SERPINF1 | P36955 | 0.00343 | 0.664 | -1.5 |
| 202273_at | PDGFRB | 206:NM_002609 | 5q31-q32 | PDGFRB | P09619 | 0.00262 | 0.656 | -1.5 |
| 213369_at | PCDH21 | 207:AI825832 | 10q22.1-q22.3 | KIAA1775 | Q8IXY5 /// Q96JP9 | 0.00184 | 0.647 | -1.5 |
| 217739_s_at | PBEF1 | 208:NM_005746 | 7q22.2 | PBEF | P43490 /// Q8WW95 | 0.00298 | 0.643 | -1.6 |
| 203963_at | CA12 | 209:NM_001218 | 15q22 | CA12 | AAP35302 /// O43570 | 0.00259 | 0.643 | -1.6 |
| 202075_s_at | PLTP | 210:NM_006227 | 20q12-q13.1 | PLTP | P55058 | 0.0011 | 0.636 | -1.6 |
| 212829_at | | 211:BE878277 | | | | 0.00187 | 0.630 | -1.6 |
| 214459_x_at | HLA-C | 212:M12679 | 6p21.3 | HLA-C | * see addendum | 0.000401 | 0.628 | -1.6 |
| 211795_s_at | FYB | 213:AF198052 | 5p13.1 | FYB | O15117 /// Q9NZI9 /// Q9P111 | 0.00213 | 0.622 | -1.6 |
| 2080070_s_at | REV3L | 214:NM_002912 | 6q21 | REV3L | O60673 /// Q8IWK0 /// Q9UG47 /// Q9UID5 | 0.00199 | 0.616 | -1.6 |
| 211529_x_at | HLA-G | 215:M90684 | 6p21.3 | HLA-G | * see below | 0.00304 | 0.610 | -1.6 |
| 211529_x_at | AAQ83724 /// O02923 /// O02924 /// O78135 /// O78136 /// P17693 /// Q29897 /// Q30182 /// Q31611 /// Q8WLS1 /// O78132 | | | | O02925 /// O02926 /// O02927 /// O02928 /// O02929 /// O78131 /// O78132 | | | | |
| 211529_x_at | /// O78133 /// O78134 /// Q9MYA2 /// Q9UM45 | | | | | | | | |
| 211529_x_at | Q95HM6 /// Q9MYA2 /// Q9UM45 | | | | | | | | |

Figure 3A.10

| | | | | | | |
|---|---|---|---|---|---|---|
| 208894_at | HLA-DRA | 216 | M60334 | 6p21.3 | HLA-DRA | O19720 /// P01903 /// Q29868 /// Q30118 /// Q7YPT8 /// Q9TP70 | 0.00112 | 0.602 | -1.7 |
| 205549_at | PCP4 | 217 | NM_006198 | 21q22.2 | PCP4 | P48539 | 0.00217 | 0.600 | -1.7 |
| 32128_at | CCL18 | 218 | Y13710 | 17q11.2 | CCL18 | P55774 | 0.00216 | 0.598 | -1.7 |
| 203765_at | GCA | 219 | NM_012198 | 2q24.3 | GCA | P28676 | 0.000238 | 0.595 | -1.7 |
| 208812_x_at | HLA-C | 220 | BC004489 | 6p21.3 | HLA-C | * see addendum | 0.00243 | 0.593 | -1.7 |
| 221185_s_at | DKFZp434B22 | 221 | NM_025111 | 3q29 | DKFZp434B2 | Q9BST2 /// Q9H095 /// Q9H5C8 /// Q9HAG8 | 0.00194 | 0.575 | -1.7 |
| 201666_at | TIMP1 | 222 | NM_003254 | xp11.3-p11.23 | TIMP1 | P01033 /// Q96QM2 | 0.00347 | 0.574 | -1.7 |
| 210102_at | LOH11CR2A | 223 | BC001234 | 11q23 | LOH11CR2A | | 0.00299 | 0.566 | -1.8 |
| | AAQ94871 /// AAQ94872 /// AAQ94873 /// AAQ94874 /// AAQ94875 /// AAQ94876 /// O00534 /// Q9BVF8 | | | | | | | | |
| 201137_s_at | HLA-DPB1 | 224 | NM_002121 | 6p21.3 | HLA-DPB1 | * see below | 0.00145 | 0.555 | -1.8 |
| 201137_s_at | O19702 /// P01916 /// P04232 /// P04440 /// P13763 /// Q14465 /// Q29670 /// Q29754 /// Q30030 /// Q30058 | | | | | | | | |
| 201137_s_at | /// Q30059 /// Q30060 /// Q30174 /// Q30212 /// Q95465 /// Q95HA4 /// Q95HC1 | | | | | | | | |
| 208146_s_at | CPVL | 225 | NM_031311 | 7p15-p14 | CPVL | AAQ88913 /// Q9H3G5 /// Q9NZ90 | 0.00119 | 0.555 | -1.8 |
| 212464_at | FN1 | 226 | X02761 | 2q34 | FN1 | * see below | 0.00313 | 0.550 | -1.8 |
| 212464_s_at | AAA52465 /// AAH05858 /// AAH16875 /// CAE45714 /// CAE45786 /// CAE45847 /// CAE45885 /// CAE45932 | | | | | | | | |
| 212464_s_at | /// CAE45958 /// CAE46002 /// CAE46200 /// O95608 / O95617 / P02751 / Q14328 / Q72391 / Q9H382 / Q9UQS6 | | | | | | | | |
| 211548_s_at | HPGD | 227 | J05594 | 4q34-q35 | HPGD | O00749 /// P15428 /// Q12998 | 0.00167 | 0.549 | -1.8 |
| 211896_s_at | DCN | 228 | AF138302 | 12q13.2 | DCN | CAE11881 /// P07585 | 0.00252 | 0.535 | -1.9 |
| 212230_at | PPAP2B | 229 | AV725664 | 1pter-p22.1 | PPAP2B | O14495 | 0.00222 | 0.530 | -1.9 |
| 218795_at | ACP6 | 230 | NM_016361 | 1q21 | ACP6 | AAQ88916 /// Q9NPH0 | 0.00313 | 0.524 | -1.9 |
| 211991_s_at | HLA-DPA1 | 231 | M27487 | 6p21.3 | HLA-DPA1 | P20036 /// Q95HB9 | 0.00017 | 0.503 | -2.0 |
| 202531_at | IRF1 | 232 | NM_002198 | 5q31.1 | IRF1 | P10914 | 0.0034 | 0.495 | -2.0 |
| 209708_at | MOXD1 | 233 | AY007239 | 6q23.1-23.3 | MOXD1 | * see below | 9.80E-05 | 0.487 | -2.1 |
| | AAQ89452 /// Q8NC97 /// Q8WV49 /// Q9H4M6 /// Q9Y4U3 | | | | | | | | |
| 212588_at | PTPRC | 234 | Y00062 | 1q31-q32 | PTPRC | AAH14239 /// P08575 | 0.00236 | 0.487 | -2.1 |
| 213293_s_at | TRIM22 | 235 | AA083478 | 11p15 | TRIM22 | Q15521 /// Q8IYM9 | 0.00187 | 0.485 | -2.1 |
| 213975_s_at | LYZ | 236 | AV711904 | 12q14.3 | LYZ | P00695 | 0.000432 | 0.436 | -2.3 |
| 201069_at | MMP2 | 237 | NM_004530 | 16q13-q21 | MMP2 | P08253 | 0.00183 | 0.432 | -2.3 |
| 214536_at | ARS | 238 | NM_020427 | 8q24.3 | ARS | | 0.00338 | 0.385 | -2.6 |
| 212224_at | ALDH1A1 | 239 | NM_000689 | 9q21.13 | ALDH1A1 | AAP35567 /// P00352 | 0.00171 | 0.383 | -2.6 |

Figure 3A.11

| | | | | | | | |
|---|---|---|---|---|---|---|---|
| 202768_at | FOSB | 240 | NM_006732 | 19q13.32 | FOSB | P53539 | 0.000436 | 0.315 | -3.2 |
| 205337_at | DCT | 241 | AL139318 | 13q32 | DCT | O75767 /// P40126 /// Q9NQD7 /// Q9NQD8 | 0.00328 | 0.273 | -3.7 |
| 212187_x_at | PTGDS | 242 | NM_000954 | 9q34.2-q34.3 | PTGDS | P41222 | 0.00326 | 0.236 | -4.2 |
| 217232_x_at | HBB | 243 | AF059180 | 11p15.5 | --- | --- | 0.000968 | 0.087 | -11.5 |
| 211696_x_at | HBB | 244 | AF349114 | 11p15.5 | HBB | P02023 /// Q8IZI1 /// Q9UK54 | 0.00139 | 0.067 | -15.0 |
| 211699_x_at | HBA2 | 245 | AF349571 | 16p13.3 | HBA2 | * see below | 0.00115 | 0.060 | -16.6 |
| 204018_x_at | AAC97373 /// AAH05931 /// AAH50661 /// Q96KF1 /// Q9NQT3 HBA2 | 246 | NM_000558 | 16p13.3 | HBA2 | * see below | 0.00111 | 0.058 | -17.1 |
| 209458_x_at | AAC97373 /// AAH05931 /// AAH50661 /// Q96KF1 /// Q9NQT3 HBA2 | 247 | AF105974 | 16p13.3 | HBA2 | * see below | 0.00127 | 0.057 | -17.6 |
| 211745_x_at | AAC97373 /// AAH05931 /// AAH50661 /// Q96KF1 /// Q9NQT3 HBA2 | 248 | BC005931 | 16p13.3 | --- | --- | 0.00101 | 0.055 | -18.0 |
| 217414_x_at | HBA2 | 249 | V00489 | 16p13.3 | HBA2 | * see below | 0.00102 | 0.052 | -19.1 |
| 214414_x_at | AAC97373 /// AAH05931 /// AAH50661 /// Q96KF1 /// Q9NQT3 | 250 | T50399 | 16p13.3 | HBA2 | P02023 /// Q8IZI1 /// Q9UK54 | 0.00112 | 0.051 | -19.6 |
| 209116_x_at | HBB | 251 | M25079 | 11p15.5 | HBB | | 0.00171 | 0.045 | -22.0 |

Figure 3A.12

| SEQ ID No. | SwissProt Affymetrix |
|---|---|
| 204 | AAN15205 /// CAE45568 /// O02951 /// O19190 /// O19507 /// O19517 /// O19585 /// O19586 /// O19587 /// O19622 /// O19719 /// O19721 /// O19725 /// O19727 /// O19728 /// O19730 /// O19740 /// O19742 /// O19743 /// O19762 /// O19763 /// O77961 /// O77966 /// O78042 /// O78117 /// P01912 /// P01913 /// P01914 /// P04229 /// P13760 /// P13761 /// P13762 /// P20039 /// P79483 /// P79552 /// Q13365 /// Q29671 /// Q29672 /// Q29673 /// Q29696 /// Q29703 /// Q29717 /// Q29726 /// Q29745 /// Q29769 /// Q29787 /// Q29788 /// Q29789 /// Q29790 /// Q29791 /// Q29792 /// Q29889 /// Q29890 /// Q29901 /// Q29971 /// Q29972 /// Q29973 /// Q29974 /// Q29975 /// Q30008 /// Q30009 /// Q30103 /// Q30104 /// Q30109 /// Q30112 /// Q30114 /// Q30120 /// Q30131 /// Q30134 /// Q30136 /// Q30137 /// Q30142 /// Q30143 /// Q30147 /// Q30148 /// Q30150 /// Q30151 /// Q30152 /// Q30154 /// Q30158 /// Q30159 /// Q30162 /// Q30164 /// Q30165 /// Q30166 /// Q30167 /// Q30178 /// Q30179 /// Q7YPT7 /// Q860C0 /// Q860Y4 /// Q8NEI3 /// Q8TB62 /// Q8WLU3 /// Q95379 /// Q95462 /// Q95HK1 /// Q95HK2 /// Q95HL8 /// Q95IE3 /// Q95IH1 /// Q95IT4 /// Q96HZ9 /// Q9BS54 /// Q9GIY0 /// Q9GIY1 /// Q9GIY2 /// Q9GIY3 /// Q9MYB9 /// Q9TQD6 /// Q9TQD7 /// Q9TQD8 /// Q9TQD9 /// Q9TQE0 /// Q9TQE1 |
| 212 | BAA32612 /// BAC86939 /// O19653 /// O19655 /// O19657 /// O19677 /// O78164 /// O78179 /// P04222 /// P10321 /// P30499 /// P30501 /// P30504 /// P30505 /// P30508 /// P30510 /// P79497 /// Q04826 /// Q07000 /// Q14838 /// Q29645 /// Q29659 /// Q29676 /// Q29710 /// Q29761 /// Q29763 /// Q29865 /// Q29866 /// Q29951 /// Q29952 /// Q29958 /// Q29960 /// Q29963 /// Q29988 /// Q7YNW6 /// Q861B1 /// Q8SNA8 /// Q8SNB1 /// Q8SP61 /// Q8SP65 /// Q8WZ43 /// Q95604 /// Q95HC2 /// Q95HL2 /// Q95HM2 /// Q95HM3 /// Q95HN1 /// Q96FQ5 /// Q96QL3 /// Q9MY34 /// Q9TNN7 /// Q9TNU1 |
| 220 | BAA32612 /// BAC86939 /// O19653 /// O19655 /// O19657 /// O19677 /// O78164 /// O78179 /// P04222 /// P10321 /// P30499 /// P30501 /// P30504 /// P30505 /// P30508 /// P30510 /// P79497 /// Q04826 /// Q07000 /// Q14838 /// Q29645 /// Q29659 /// Q29676 /// Q29710 /// Q29761 /// Q29763 /// Q29865 /// Q29866 /// Q29951 /// Q29952 /// Q29958 /// Q29960 /// Q29963 /// Q29988 /// Q7YNW6 /// Q861B1 /// Q8SNA8 /// Q8SNB1 /// Q8SP61 /// Q8SP65 /// Q8WZ43 /// Q95604 /// Q95HC2 /// Q95HL2 /// Q95HM2 /// Q95HM3 /// Q95HN1 /// Q96FQ5 /// Q96QL3 /// Q9MY34 /// Q9TNN7 /// Q9TNU1 |
| | |

Figure 3A.13

| 3-way ANOVA 18% FDR for site | | | | | | | | | | | | | | | |
|---|---|---|---|---|---|---|---|---|---|---|---|---|---|---|---|
| 10 Samp GCRMA | | | | | | | | | | | | | | | |
| Name ()* | | JD63D | JD63R | KF43D | KF43R | MF47D | MF47R | SL48D | SL48R | TH44D | TH44R | | | | |
| Patient ()*S | | JD63 | JD63 | KF43 | KF43 | MF47 | MF47 | SL48 | SL48 | TH44 | TH44 | | | | |
| Systematic | SEQ ID No. | Raw | Raw | Raw | Raw | Raw | Raw | Raw | Raw | Raw | Raw | | | | |
| 220970_s_at | 1 | 1604.96 | 69.5889 | 570.144 | 11.7299 | 1634.49 | 44.7466 | 1738.75 | 19.1804 | 2328.67 | 97.5225 | | | | |
| 207787_at | 2 | 2000.9 | 104.731 | 911.129 | 20.933 | 2059.67 | 76.4817 | 2389.62 | 32.1337 | 2067.23 | 101.846 | | | | |
| 220972_s_at | 3 | 2507.57 | 201.196 | 751.921 | 13.721 | 1774.8 | 81.8986 | 2535.47 | 25.2233 | 2442.4 | 125.611 | | | | |
| 206969_at | 4 | 3023.11 | 115.787 | 727.862 | 23.3867 | 2026.73 | 77.9744 | 2325.9 | 29.7674 | 2519.32 | 153.897 | | | | |
| 208483_x_at | 5 | 6100.28 | 297.827 | 4475.68 | 121.117 | 6884.22 | 418.162 | 7290.37 | 144.925 | 6600.45 | 252.368 | | | | |
| 220976_s_at | 6 | 2392.02 | 166.825 | 881.167 | 36.9836 | 2313.58 | 88.2431 | 2493.72 | 33.9929 | 3255.51 | 163.807 | | | | |
| 220978_at | 7 | 3922.11 | 242.587 | 969.001 | 29.5128 | 2213.44 | 130.216 | 3211.52 | 52.017 | 3438.66 | 152.777 | | | | |
| 206677_at | 8 | 5248.72 | 360.218 | 4283.04 | 158.257 | 8334.19 | 490.994 | 7315.78 | 214.569 | 6657.84 | 508.049 | | | | |
| 221297_at | 9 | 488.381 | 34.2586 | 296.962 | 14.477 | 621.386 | 34.3049 | 700.485 | 19.0717 | 520.319 | 35.4226 | | | | |
| 213711_at | 10 | 1232.5 | 73.5477 | 656.045 | 57.5239 | 1249.5 | 76.1112 | 1314.12 | 37.0582 | 1626.57 | 74.7843 | | | | |
| 215189_at | 11 | 2038.09 | 160.414 | 886.126 | 33.2065 | 1592.04 | 115.047 | 1707.5 | 55.9812 | 2051.9 | 143.889 | | | | |
| 206423_at | 12 | 263.375 | 15.7046 | 176.845 | 5.40903 | 142.832 | 14.81 | 288.615 | 7.75391 | 303.112 | 30.8671 | | | | |
| 207457_s_at | 13 | 739.217 | 33.3834 | 516.484 | 24.8 | 698.562 | 54.3653 | 755.684 | 20.3366 | 710.6 | 88.0533 | | | | |
| 216810_at | 14 | 2101.7 | 256.993 | 649.497 | 20.3013 | 1534.23 | 113.68 | 1895.72 | 49.502 | 2037.06 | 181.153 | | | | |
| 216921_s_at | 15 | 2166.35 | 193.46 | 1978.3 | 66.8107 | 2678.54 | 194.767 | 2257.78 | 67.4008 | 2864.58 | 314.951 | | | | |
| 207669_at | 16 | 350.727 | 34.7875 | 354.059 | 30.1758 | 898.509 | 75.1844 | 976.442 | 22.6213 | 1088.65 | 48.9888 | | | | |
| 206027_at | 17 | 1632.17 | 72.6721 | 1149.24 | 67.749 | 1413.53 | 124.757 | 1381.24 | 58.471 | 1727.95 | 154.6 | | | | |
| 205713_s_at | 18 | 264.263 | 18.7375 | 405.125 | 21.9955 | 297.711 | 39.413 | 615.86 | 16.5772 | 464.82 | 36.005 | | | | |
| 207670_at | 19 | 4950.52 | 403.902 | 3238.4 | 139.95 | 5373.51 | 430.562 | 3801.57 | 142.248 | 5353 | 619.553 | | | | |
| 207146_at | 20 | 624.753 | 65.5092 | 405.793 | 36.2474 | 625.555 | 63.7042 | 501.38 | 30.0358 | 626.444 | 100.612 | | | | |
| 220635_at | 21 | 916.78 | 80.9809 | 523.103 | 88.2309 | 813.163 | 107.388 | 648.546 | 42.6202 | 742.951 | 66.635 | | | | |
| 213880_at | 22 | 122.153 | 33.6159 | 195.827 | 16.5988 | 199.535 | 26.4623 | 298.838 | 25.317 | 261.835 | 66.9087 | | | | |
| 206987_x_at | 23 | 38.0367 | 8.47483 | 48.1733 | 8.3008 | 57.0503 | 8.19239 | 49.0652 | 6.0298 | 43.3297 | 8.57479 | | | | |
| 211029_x_at | 24 | 50.2501 | 12.0465 | 65.01 | 10.0216 | 60.9652 | 10.0877 | 62.8708 | 7.5508 | 54.6124 | 11.0205 | | | | |
| 207065_at | 25 | 896.495 | 134.468 | 1149.03 | 186.589 | 1161.63 | 200.322 | 1350.06 | 249.415 | 1007.77 | 194.175 | | | | |
| 202833_s_at | 26 | 83.3881 | 22.1061 | 120.796 | 10.4056 | 84.9552 | 14.5445 | 214.328 | 31.045 | 111.926 | 32.262 | | | | |
| 208092_s_at | 27 | 17.7042 | 6.1606 | 23.9998 | 4.02251 | 35.2099 | 7.50581 | 30.6256 | 6.36059 | 47.517 | 5.20964 | | | | |
| 213780_at | 28 | 5982.67 | 1232.42 | 4406.82 | 901.374 | 6187.23 | 1175.52 | 5025.57 | 672.767 | 6019.51 | 1632.25 | | | | |
| 213909_at | 29 | 491.591 | 88.011 | 399.798 | 91.3188 | 712.539 | 135.643 | 520.26 | 111.195 | 542.241 | 168.672 | | | | |
| 204687_at | 30 | 260.847 | 70.112 | 293.225 | 50.0824 | 254.096 | 81.0515 | 275.712 | 66.1575 | 185.549 | 40.016 | | | | |
| 219932_at | 31 | 55.7356 | 18.2266 | 60.5325 | 16.8705 | 108.416 | 26.7377 | 101.366 | 13.1422 | 80.5168 | 27.6082 | | | | |
| 222351_at | 32 | 99.4167 | 26.7475 | 79.8922 | 22.5303 | 107.231 | 20.7677 | 83.3613 | 21.6383 | 131.414 | 36.7211 | | | | |
| 218935_at | 33 | 34.1787 | 13.6374 | 71.9897 | 12.9771 | 75.5556 | 20.7715 | 100.599 | 22.7747 | 100.931 | 25.9029 | | | | |
| 203304_at | 34 | 91.3375 | 46.0103 | 129.076 | 26.7089 | 240.204 | 40.2605 | 141.822 | 42.5812 | 148.003 | 38.5824 | | | | |
| 209800_at | 35 | 2233.51 | 508.038 | 3413.25 | 574.903 | 3048.41 | 1054.88 | 4572.13 | 1323.25 | 2795.3 | 1003.07 | | | | |
| 209343_at | 36 | 118.48 | 35.1101 | 101.52 | 32.4205 | 202.555 | 44.365 | 132.314 | 44.3569 | 172.513 | 34.6024 | | | | |

Figure 3B.1

| | | | | | | | | | | |
|---|---|---|---|---|---|---|---|---|---|---|
| 220272_at | 37 | 113.261 | 37.6459 | 123.506 | 28.5228 | 137.45 | 28.2886 | 98.9126 | 35.4608 | 122.933 | 34.2704 |
| 212915_at | 38 | 661.112 | 323.912 | 1016.28 | 213.012 | 1477.31 | 417.225 | 1561.67 | 299.86 | 1372.25 | 461.004 |
| 221558_s_at | 39 | 110.058 | 38.3016 | 83.8073 | 19.0949 | 162.678 | 38.008 | 133.205 | 70.2921 | 189.223 | 37.2633 |
| 203921_at | 40 | 238.614 | 85.5057 | 229.892 | 62.2049 | 358.113 | 89.0918 | 358.507 | 107.753 | 364.317 | 98.5462 |
| 205290_s_at | 41 | 40.1749 | 8.3747 | 49.2306 | 13.7695 | 70.0077 | 23.549 | 77.0902 | 19.7003 | 13.3271 | 5.21872 |
| 202376_at | 42 | 1108.25 | 181.141 | 573.049 | 243.349 | 636.976 | 206.991 | 971.29 | 193.846 | 829.869 | 366.409 |
| 210393_at | 43 | 47.3486 | 21.6155 | 61.9036 | 14.123 | 42.0578 | 13.0054 | 74.3267 | 14.347 | 51.9171 | 20.0683 |
| 37892_at | 44 | 48.4479 | 15.2096 | 100.728 | 19.422 | 183.828 | 37.3998 | 106.774 | 47.9512 | 134.169 | 61.1883 |
| 206140_at | 45 | 481.683 | 239.622 | 717.764 | 149.883 | 695.275 | 216.913 | 513.912 | 174.379 | 582.363 | 148.611 |
| 201109_s_at | 46 | 110.832 | 29.588 | 92.2604 | 25.3211 | 88.0331 | 31.1126 | 177.539 | 39.5767 | 69.9725 | 36.6011 |
| 202886_s_at | 47 | 59.6777 | 17.6108 | 72.8137 | 34.5636 | 114.815 | 32.7324 | 101.185 | 32.8405 | 74.7466 | 24.9772 |
| 205374_at | 48 | 31.8983 | 13.3115 | 33.3483 | 11.6745 | 43.7766 | 11.366 | 43.9605 | 10.0974 | 32.845 | 17.0242 |
| 219250_s_at | 49 | 106.049 | 45.8178 | 313.275 | 125.752 | 404.791 | 106.412 | 370.086 | 118.54 | 253.26 | 87.6087 |
| 219832_s_at | 50 | 143.042 | 74.8151 | 142.362 | 37.7729 | 188.492 | 66.9347 | 231.318 | 54.68 | 179.164 | 80.4928 |
| 202883_s_at | 51 | 134.517 | 68.9875 | 128.442 | 57.8158 | 225.739 | 62.585 | 209.37 | 60.412 | 233.057 | 70.8351 |
| 209921_at | 52 | 47.9115 | 15.8107 | 27.7477 | 12.8758 | 53.9387 | 18.8727 | 47.3508 | 11.8824 | 39.2149 | 16.5586 |
| 211071_s_at | 53 | 162.265 | 74.2637 | 199.772 | 85.4313 | 306.287 | 78.1692 | 277.079 | 72.0012 | 277.308 | 126.119 |
| 216603_at | 54 | 121.553 | 37.3001 | 46.5093 | 24.5615 | 65.7858 | 27.8604 | 67.4256 | 26.5479 | 119.565 | 28.1612 |
| 211219_s_at | 55 | 26.8678 | 10.09 | 43.7826 | 18.0286 | 55.0506 | 21.996 | 50.3977 | 16.8061 | 35.5951 | 11.0296 |
| 202016_at | 56 | 109.735 | 60.6879 | 187.415 | 61.8384 | 212.549 | 60.2696 | 203.112 | 72.3649 | 301.14 | 126.11 |
| 215034_s_at | 57 | 663.919 | 300.864 | 678.29 | 292.514 | 1120.73 | 325.406 | 1259.93 | 329.327 | 725.349 | 396.606 |
| 202884_s_at | 58 | 156.57 | 73.346 | 124.386 | 64.5531 | 195.554 | 55.8647 | 168.468 | 50.9652 | 188.846 | 76.9632 |
| 206315_at | 59 | 38.5886 | 21.0922 | 60.7213 | 20.3408 | 52.9304 | 26.176 | 71.7904 | 18.6544 | 55.9672 | 21.6755 |
| 209286_at | 60 | 148.543 | 54.0698 | 91.549 | 27.9185 | 115.005 | 48.1634 | 146.758 | 56.5211 | 102.731 | 53.1928 |
| 203980_at | 61 | 1052.57 | 573.772 | 1331.54 | 474.099 | 2565.72 | 707.256 | 1179.64 | 554.599 | 2221.77 | 834.366 |
| 210319_x_at | 62 | 53.9473 | 30.8755 | 49.6564 | 25.449 | 113.404 | 32.641 | 81.2968 | 24.8272 | 102.276 | 38.1904 |
| 204351_at | 63 | 400.054 | 137.048 | 561.796 | 200.818 | 590.353 | 364.309 | 639.241 | 234.997 | 389.138 | 144.895 |
| 212154_at | 64 | 189.726 | 111.923 | 347.202 | 114.631 | 355.172 | 131.444 | 357.941 | 126.072 | 297.629 | 122.094 |
| 202391_at | 65 | 649.943 | 230.763 | 679.159 | 253.939 | 700.902 | 281.841 | 666.799 | 336.239 | 800.909 | 315.81 |
| 214036_at | 66 | 95.4739 | 64.9788 | 144.871 | 43.4639 | 140.229 | 50.9396 | 149.681 | 55.0241 | 84.7376 | 39.7256 |
| 209288_s_at | 67 | 112.563 | 55.3046 | 143.909 | 55.0305 | 264.693 | 70.6892 | 229.645 | 111.126 | 182.181 | 98.7428 |
| 213100_at | 68 | 72.3815 | 33.2628 | 110.834 | 55.93 | 107.197 | 48.0037 | 110.626 | 45.4469 | 75.5555 | 23.8454 |
| 215785_s_at | 69 | 117.836 | 54.2 | 168.329 | 63.7101 | 127.518 | 58.8188 | 134.965 | 58.1545 | 161.816 | 65.0011 |
| 200906_s_at | 70 | 386.112 | 136.023 | 344.249 | 145.86 | 314.713 | 163.856 | 414.33 | 202.411 | 200.322 | 77.2015 |
| 205932_s_at | 71 | 72.1894 | 29.7626 | 62.0171 | 26.734 | 65.5798 | 21.0575 | 47.2371 | 26.6716 | 46.3561 | 23.0676 |
| 205289_at | 72 | 59.4989 | 32.2428 | 56.3272 | 25.4338 | 72.0144 | 33.9914 | 92.9519 | 41.7239 | 106.2 | 36.9109 |
| 216092_s_at | 73 | 272.748 | 127.615 | 161.051 | 76.2352 | 238.21 | 102.887 | 213.598 | 83.5582 | 211.157 | 109.439 |
| 210074_at | 74 | 2027.89 | 885.943 | 4024.06 | 2134.37 | 4092.14 | 1763.39 | 4777.61 | 1648.36 | 3612.14 | 2057.88 |
| 213556_at | 75 | 36.6162 | 24.4302 | 56.6792 | 28.5928 | 48.6356 | 19.8461 | 68.2912 | 26.2144 | 51.0704 | 20.8736 |
| 203797_at | 76 | 372.654 | 159.011 | 463.391 | 247.733 | 462.204 | 214.586 | 488.638 | 218.584 | 496.512 | 236.869 |
| 219229_at | 77 | 135.472 | 65.4688 | 154.954 | 73.1447 | 158.399 | 91.4652 | 180.855 | 80.633 | 159.728 | 65.8537 |
| 202166_s_at | 78 | 252.976 | 131.788 | 214.127 | 115.16 | 347.736 | 156.75 | 409.941 | 186.482 | 383.459 | 166.611 |

Figure 3B.2

| | | | | | | | | | | |
|---|---|---|---|---|---|---|---|---|---|---|
| 204256_at | 79 | 42.1349 | 29.4494 | 83.7727 | 36.5374 | 94.4431 | 48.4144 | 103.646 | 39.9739 | 147.993 | 65.0532 |
| 202693_s_at | 80 | 122.209 | 73.2888 | 114.432 | 60.6712 | 200.166 | 84.7997 | 183.71 | 81.2522 | 228.506 | 107.891 |
| 205472_s_at | 81 | 17.082 | 11.8354 | 23.8623 | 10.3709 | 32.248 | 16.6819 | 25.288 | 10.8515 | 27.6114 | 12.0212 |
| 203798_s_at | 82 | 172.193 | 95.5308 | 240.447 | 131.981 | 256.147 | 118.301 | 312.694 | 107.541 | 202.95 | 122.68 |
| 202363_at | 83 | 25.6955 | 17.2377 | 35.2979 | 14.8521 | 40.6906 | 19.5211 | 42.8786 | 17.794 | 70.4338 | 38.4581 |
| 200730_s_at | 84 | 141.07 | 72.3715 | 146.194 | 73.1715 | 348.74 | 129.763 | 248.485 | 110 | 135.125 | 99.3325 |
| 204141_at | 85 | 2233.2 | 1179.32 | 2129.9 | 948.907 | 2653.57 | 1465.55 | 2732.32 | 1382.09 | 3034.06 | 1466.02 |
| 202436_s_at | 86 | 663.372 | 401.707 | 846.997 | 378.642 | 882.844 | 619.255 | 886.795 | 373.201 | 698.035 | 295.294 |
| 208637_x_at | 87 | 633.644 | 272.205 | 855.144 | 503.37 | 711.17 | 455.558 | 854.595 | 410.101 | 464.853 | 206.003 |
| 204682_at | 88 | 394.767 | 233.843 | 331.119 | 213.725 | 331.605 | 161.983 | 428.065 | 188.005 | 386.377 | 172.288 |
| 203574_at | 89 | 282.067 | 152.399 | 407.629 | 184.473 | 554.599 | 241.307 | 496.114 | 254.539 | 306.912 | 207.366 |
| 214104_at | 90 | 29.6578 | 16.5981 | 45.8924 | 26.1209 | 42.4274 | 21.4493 | 32.55 | 21.6303 | 34.4175 | 12.9421 |
| 201105_at | 91 | 1741.54 | 901.931 | 1996.05 | 1037.94 | 1666.77 | 942.928 | 2243.45 | 1176.16 | 1859.85 | 1028.22 |
| 209126_x_at | 92 | 4905.49 | 2421.4 | 6495.63 | 4361.14 | 5603.24 | 3180.27 | 6560.51 | 3252.75 | 5122.72 | 2615.74 |
| 213135_at | 93 | 354.604 | 148.373 | 402.609 | 230.884 | 407.134 | 298.756 | 417.253 | 216.108 | 362.138 | 199.279 |
| 200907_s_at | 94 | 1285.61 | 737.746 | 1473.66 | 866.499 | 1629 | 932.962 | 1946.35 | 976.688 | 1578.03 | 829.128 |
| 217933_s_at | 95 | 922.677 | 623.41 | 975.347 | 549.177 | 1606.29 | 651.016 | 1423.08 | 941.116 | 1528.2 | 765.824 |
| 217897_at | 96 | 52.4861 | 28.264 | 146.285 | 77.1714 | 104.928 | 57.7166 | 135.051 | 76.3207 | 124.877 | 80.5463 |
| 201266_at | 97 | 182.139 | 108.944 | 180.069 | 104.344 | 237.562 | 144.735 | 214.49 | 128.763 | 240.347 | 115.221 |
| 215253_s_at | 98 | 149.396 | 87.7473 | 113.332 | 65.7467 | 117.301 | 55.4086 | 118.997 | 67.6158 | 76.6712 | 51.0365 |
| 201286_at | 99 | 1261.34 | 607.888 | 1462.06 | 989.861 | 1708.67 | 1044.43 | 1820.62 | 858.636 | 1346.85 | 896.454 |
| 209772_s_at | 100 | 283.2 | 139.829 | 397.679 | 230.43 | 390.71 | 254.976 | 455.015 | 279.668 | 271.539 | 151.456 |
| 221881_s_at | 101 | 76.9896 | 54.49 | 144.355 | 80.4486 | 177.584 | 93.876 | 164.812 | 89.1817 | 96.5978 | 57.967 |
| 201616_s_at | 102 | 278.02 | 184.93 | 338.495 | 192.043 | 444.529 | 282.727 | 484.238 | 255.415 | 323.874 | 176.069 |
| 209283_at | 103 | 526.564 | 308.116 | 623.581 | 338.147 | 686.541 | 343.493 | 667.41 | 459.802 | 664.178 | 433.908 |
| 37408_at | 104 | 403.463 | 220.596 | 297.003 | 172.96 | 296.248 | 211.092 | 270.254 | 153.459 | 349.956 | 212.373 |
| 200897_s_at | 105 | 1202.83 | 885.314 | 1380.04 | 743.207 | 1437 | 870.995 | 1521.18 | 789.816 | 1463.43 | 982.206 |
| 208636_at | 106 | 1198.6 | 753.3 | 1425.75 | 950.343 | 1702.65 | 895.038 | 1727.48 | 976.196 | 1982.29 | 1337.63 |
| 208708_x_at | 107 | 343.706 | 247.469 | 538.676 | 358.712 | 487.476 | 329.667 | 611.784 | 302.121 | 635.956 | 366.031 |
| 205157_s_at | 108 | 6740.85 | 4612.84 | 9264.14 | 7124.01 | 8104.02 | 4396.34 | 8816.21 | 5184.1 | 7663.93 | 4341.22 |
| 204029_at | 109 | 164.446 | 91.1265 | 209.519 | 123.159 | 198.273 | 154.727 | 236.986 | 126.764 | 196.438 | 139.193 |
| 200644_at | 110 | 277.689 | 179.962 | 497.218 | 253.329 | 506.133 | 300.121 | 620.703 | 422.63 | 442.356 | 342.315 |
| 210987_x_at | 111 | 707.378 | 401.427 | 787.631 | 530.796 | 867.104 | 530.565 | 1028.89 | 561.944 | 876.688 | 711.129 |
| 201397_at | 112 | 244.691 | 149.897 | 344.58 | 209.956 | 256.811 | 211.147 | 324.885 | 172.801 | 264.353 | 170.666 |
| 202936_s_at | 113 | 883.633 | 715.483 | 1278.36 | 795.917 | 1269.46 | 744.876 | 1137.72 | 641.764 | 1371.59 | 873.112 |
| 41856_at | 114 | 75.6192 | 59.3453 | 159.886 | 102.846 | 131.869 | 70.443 | 110.155 | 67.9441 | 99.5771 | 63.6149 |
| 202066_at | 115 | 152.924 | 99.3167 | 186.051 | 134.557 | 254.259 | 160.653 | 262.796 | 132.42 | 257.205 | 187.794 |
| 201841_s_at | 116 | 3893.92 | 2798.18 | 6783.59 | 3800.8 | 5789.92 | 4241.57 | 6739 | 4511.8 | 4060.58 | 2285.98 |
| 209099_x_at | 117 | 751.198 | 600.238 | 891.479 | 499.523 | 1073.04 | 625.04 | 990.837 | 630.503 | 782.776 | 533.337 |
| 214590_s_at | 118 | 39.2742 | 23.1385 | 25.758 | 17.0609 | 38.8582 | 28.2413 | 41.1498 | 24.5002 | 46.7024 | 34.0381 |
| 205125_at | 119 | 386.908 | 249.786 | 290.791 | 240.469 | 359.016 | 235.838 | 343.603 | 199.813 | 342.535 | 210.577 |
| 203585_at | 120 | 239.93 | 130.067 | 363.193 | 239.216 | 338.294 | 262.225 | 362.868 | 249.575 | 329.357 | 231.896 |

Figure 3B.3

| | | | | | | | | | |
|---|---|---|---|---|---|---|---|---|---|
| 203367_at | 121 | 168.414 | 105.652 | 212.846 | 126.965 | 188.379 | 159.728 | 183.424 | 118.004 | 236.536 | 163.728 |
| 204255_s_at | 122 | 269.087 | 162.771 | 295.348 | 193.265 | 287.355 | 211.563 | 301.554 | 201.749 | 165.16 | 120.434 |
| 211383_s_at | 123 | 47.578 | 32.3493 | 70.3807 | 39.4112 | 54.5099 | 42.7894 | 61.1665 | 41.1923 | 45.757 | 33.1146 |
| 212426_s_at | 124 | 1857.13 | 1506.93 | 1731.48 | 1207.97 | 2021.59 | 1383.46 | 1161.74 | 1140.25 | 2673.28 | 1606.03 |
| 213072_at | 125 | 27.3446 | 19.0407 | 36.1338 | 28.596 | 26.3167 | 20.2841 | 32.7271 | 20.6932 | 24.0995 | 14.3371 |
| 204761_at | 126 | 78.9447 | 49.7612 | 68.0134 | 52.5367 | 105.584 | 64.3583 | 91.3606 | 65.8794 | 100.506 | 75.6179 |
| 202949_s_at | 127 | 205.734 | 170.182 | 279.809 | 196.739 | 306.034 | 228.926 | 291.024 | 179.44 | 298.496 | 181.249 |
| 210986_s_at | 128 | 1052.88 | 705.524 | 1119.42 | 843.26 | 1370.24 | 939.005 | 1447.2 | 882.358 | 1471.77 | 1157.38 |
| 214749_s_at | 129 | 161.738 | 114.38 | 237.867 | 170.599 | 269.711 | 155.359 | 244.422 | 184.536 | 277.124 | 212.243 |
| 200924_s_at | 130 | 164.149 | 116.553 | 196.146 | 148.516 | 197.742 | 156.742 | 212.155 | 124.272 | 128.415 | 87.7393 |
| 202570_s_at | 131 | 62.4132 | 44.9809 | 69.103 | 57.6928 | 81.5504 | 50.7893 | 84.5244 | 56.9042 | 74.2417 | 52.5198 |
| 209859_at | 132 | 14.2448 | 9.80859 | 14.4228 | 10.2803 | 13.1124 | 9.583 | 11.7611 | 9.89501 | 22.4351 | 13.4553 |
| 213134_x_at | 133 | 328.265 | 228.695 | 360.565 | 283.485 | 467.447 | 329.289 | 520.164 | 378.278 | 543.173 | 359.263 |
| 208949_s_at | 134 | 5517.17 | 4434.46 | 4726.95 | 3843.16 | 5117.8 | 3848.17 | 3848.17 | 3835.24 | 5640.07 | 3569.62 |
| 202345_s_at | 135 | 5705.8 | 4440.05 | 6857.47 | 4777.32 | 7606.05 | 5996.25 | 8173.73 | 5429.42 | 10809.9 | 8075.67 |
| 214004_s_at | 136 | 143.156 | 108.126 | 188.341 | 126.104 | 198 | 141.358 | 155.427 | 134.176 | 145.197 | 100.063 |
| 209344_at | 137 | 394.179 | 249.729 | 305.32 | 230.768 | 351.773 | 288.674 | 368.125 | 277.791 | 274.653 | 203.849 |
| 212365_at | 138 | 144.246 | 103.165 | 106.439 | 83.1764 | 94.5145 | 69.0935 | 100.774 | 84.8309 | 129.076 | 86.6689 |
| 205372_at | 139 | 22.0773 | 14.971 | 19.5305 | 15.9694 | 18.4294 | 14.207 | 17.8417 | 13.5272 | 26.2409 | 20.8899 |
| 204361_s_at | 140 | 33.4692 | 25.8745 | 35.3473 | 28.7016 | 44.9789 | 34.8474 | 43.194 | 28.8057 | 45.0696 | 35.9317 |
| 200824_at | 141 | 545.617 | 456.717 | 776.633 | 524.002 | 751.473 | 626.903 | 822.321 | 630.431 | 566.318 | 413.903 |
| 209427_at | 142 | 70.4484 | 60.448 | 126.098 | 86.5835 | 98.4696 | 81.4794 | 103.252 | 79.0297 | 92.4317 | 68.8581 |
| 200839_s_at | 143 | 1462.8 | 1035.28 | 1754.75 | 1328.41 | 1530.34 | 1311.45 | 1617.7 | 1230.75 | 1692.04 | 1396 |
| 36564_at | 144 | 140.639 | 111.196 | 103.506 | 74.4847 | 121.427 | 88.2511 | 111.261 | 93.0093 | 134.459 | 113.749 |
| 203423_at | 145 | 64.0231 | 53.7069 | 174.284 | 137.46 | 119.406 | 88.4413 | 156.427 | 116.569 | 152.822 | 129.443 |
| 210493_s_at | 146 | 33.3635 | 26.7726 | 42.2567 | 30.7119 | 31.7911 | 23.8814 | 25.0007 | 20.3991 | 32.9203 | 29.3477 |
| 209442_x_at | 147 | 144.252 | 124.845 | 211.277 | 183.311 | 232.231 | 174.116 | 222.74 | 177.832 | 138.249 | 102.032 |
| 201820_at | 148 | 8732.8 | 6210.65 | 9863.86 | 7771.4 | 7830.89 | 6726.19 | 7930.32 | 6432.86 | 9189.33 | 7887.94 |
| 205732_s_at | 149 | 10.8719 | 8.83817 | 9.3581 | 7.76777 | 17.8266 | 13.4183 | 13.4463 | 10.6513 | 9.35038 | 7.97909 |
| 38340_at | 150 | 216.561 | 179.155 | 231.485 | 186.302 | 201.466 | 176.807 | 214.809 | 160.923 | 206.73 | 172.743 |
| 201485_s_at | 151 | 147.926 | 118.621 | 206.877 | 167.425 | 242.504 | 216.385 | 305.306 | 253.173 | 287.802 | 221.956 |
| 218032_at | 152 | 179.682 | 139.963 | 226.848 | 189.426 | 228.224 | 190.235 | 190.122 | 156.757 | 226.599 | 198.523 |
| 214116_at | 153 | 48.3313 | 40.1317 | 42.3749 | 36.0248 | 30.4626 | 24.4313 | 45.115 | 38.299 | 55.5585 | 45.7466 |
| 201131_s_at | 154 | 1435.25 | 1261.69 | 1652.48 | 1319.07 | 1816.58 | 1562.17 | 1997.15 | 1659.54 | 1878.26 | 1532.69 |
| 211995_x_at | 155 | 7852.79 | 7272.53 | 7191.86 | 5657.27 | 7550 | 6220.76 | 7509.13 | 6345.07 | 6417.55 | 5284.42 |
| 220768_s_at | 156 | 69.0207 | 52.3924 | 105.482 | 94.402 | 147.344 | 124.814 | 120.345 | 103.824 | 107.064 | 90.3783 |
| 213811_x_at | 157 | 90.9515 | 79.4708 | 94.4194 | 75.2654 | 100.107 | 86.9433 | 105.275 | 91.277 | 130.437 | 106.512 |
| 209351_at | 158 | 19522.2 | 14999.2 | 18635 | 16440.4 | 17167.7 | 15333.4 | 19876.3 | 16440.4 | 19247 | 16544.7 |
| 212363_x_at | 159 | 4969.61 | 4036.56 | 4620.34 | 3882.43 | 5056.52 | 4472.7 | 4888.68 | 4154.37 | 4219.57 | 3863.28 |
| 209014_at | 160 | 212.029 | 176.529 | 299.578 | 243.701 | 261.087 | 225.166 | 284.754 | 258.546 | 303.133 | 274.981 |
| 202150_s_at | 161 | 24.2712 | 21.3699 | 24.2729 | 20.1207 | 29.1855 | 24.099 | 26.2866 | 22.7476 | 21.5073 | 19.9674 |
| 204131_s_at | 162 | 257.229 | 214.176 | 353.873 | 302.675 | 304.329 | 270.292 | 258.848 | 236.839 | 251.082 | 215.929 |

Figure 3B.4

| | | | | | | | | | | |
|---|---|---|---|---|---|---|---|---|---|---|
| 212971_at | 163 | 212.355 | 179.658 | 264.93 | 247.815 | 300.754 | 265.294 | 322.483 | 274.415 | 342.331 | 287.118 |
| 212741_at | 164 | 240.898 | 209.86 | 230.599 | 210.683 | 274.616 | 241.899 | 240.987 | 201.398 | 243.494 | 211.67 |
| AFFX-HSAC07/ | 165 | 8861.98 | 7837.74 | 8272.8 | 7700.96 | 8349.08 | 7547.98 | 9197.83 | 7880.01 | 9110.64 | 7978.85 |
| 209408_at | 166 | 9.0214 | 8.15963 | 12.7263 | 11.8119 | 9.90317 | 9.39934 | 11.5043 | 10.2878 | 8.59071 | 8.16786 |
| 205745_x_at | 167 | 100.364 | 91.6938 | 68.7872 | 63.2376 | 78.1192 | 72.8188 | 62.4089 | 57.1249 | 81.1331 | 76.9649 |
| 210160_at | 168 | 29.6056 | 27.8381 | 26.7738 | 25.4071 | 25.1316 | 24.1598 | 26.0457 | 24.3297 | 27.5741 | 26.0385 |
| 202706_s_at | 169 | 54.3727 | 52.2726 | 75.1758 | 72.9907 | 93.9836 | 89.7965 | 82.7811 | 75.5079 | 83.6922 | 78.2355 |
| 212087_s_at | 170 | 29.9699 | 33.3422 | 54.9524 | 60.4937 | 54.1602 | 57.9944 | 54.6587 | 57.1392 | 49.5837 | 54.7113 |
| 214011_s_at | 171 | 63.4073 | 69.934 | 143.54 | 166.214 | 126.57 | 138.579 | 147.067 | 161.731 | 110.153 | 131.794 |
| 208959_s_at | 172 | 213.593 | 232.284 | 306.602 | 338.922 | 282.022 | 312.522 | 280.431 | 330.12 | 279.706 | 332.304 |
| 203405_at | 173 | 91.0472 | 103.323 | 140.043 | 154.717 | 157.34 | 177.129 | 108.762 | 122.891 | 119.131 | 141.835 |
| 214527_s_at | 174 | 44.2493 | 50.8603 | 101.195 | 110.36 | 87.0308 | 102.955 | 89.6362 | 98.7587 | 48.0345 | 56.7077 |
| 219770_at | 175 | 32.9037 | 39.5731 | 32.0272 | 34.0982 | 33.686 | 39.9693 | 36.8467 | 42.6905 | 36.7556 | 43.9524 |
| 213136_at | 176 | 128.304 | 142.688 | 131.517 | 152.068 | 130.019 | 157.599 | 140.909 | 173.575 | 163.601 | 179.386 |
| 203501_at | 177 | 36.8298 | 44.2554 | 49.8432 | 58.5205 | 64.7129 | 76.1252 | 58.0241 | 69.6926 | 42.6563 | 48.0191 |
| 219503_s_at | 178 | 42.8315 | 49.7383 | 54.8932 | 59.9393 | 55.8033 | 71.8102 | 54.4026 | 64.5294 | 47.2684 | 58.1837 |
| 218992_at | 179 | 51.2379 | 59.2989 | 119.101 | 131.336 | 66.7541 | 85.4567 | 95.4652 | 114.251 | 71.7641 | 87.5566 |
| 220052_s_at | 180 | 86.2313 | 111.695 | 115.989 | 132.429 | 108.648 | 131.354 | 133.052 | 159.389 | 112.504 | 132.973 |
| 215460_x_at | 181 | 80.9364 | 100.635 | 113 | 126.199 | 147.831 | 173.249 | 125.749 | 158.308 | 106.273 | 140.078 |
| 203505_at | 182 | 123.721 | 161.62 | 116.66 | 132.514 | 124.062 | 167.583 | 122.829 | 158.214 | 118.844 | 138.56 |
| 207543_s_at | 183 | 57.8675 | 81.5467 | 89.3329 | 114.233 | 86.336 | 104.54 | 84.0457 | 100.792 | 78.1245 | 90.308 |
| 218418_s_at | 184 | 78.2929 | 93.6699 | 98.5169 | 112.512 | 104.528 | 127.408 | 82.365 | 113.526 | 79.0098 | 105.63 |
| 204440_at | 185 | 48.9294 | 65.8612 | 36.4305 | 44.2109 | 41.2867 | 47.5638 | 42.1774 | 54.7476 | 33.4738 | 42.9199 |
| 220942_x_at | 186 | 259.929 | 336.979 | 891.397 | 1109.32 | 870.058 | 1144.78 | 877.542 | 1015.88 | 819.125 | 1072.94 |
| 218280_x_at | 187 | 77.0707 | 95.4084 | 133.535 | 184.659 | 110.247 | 137.054 | 134.345 | 171.414 | 78.1944 | 92.8093 |
| 208717_at | 188 | 190.235 | 258.682 | 506.597 | 568.292 | 382.336 | 537.21 | 351.515 | 435.87 | 259.905 | 327.799 |
| 212706_at | 189 | 45.9871 | 60.1291 | 44.0532 | 52.1602 | 77.8317 | 102.271 | 62.9818 | 79.5618 | 95.7805 | 130.085 |
| 218119_at | 190 | 41.3359 | 55.7625 | 106.837 | 144.812 | 96.7905 | 118.448 | 95.7169 | 113.675 | 81.3303 | 114.464 |
| 202686_s_at | 191 | 53.1149 | 76.0694 | 48.8667 | 68.9038 | 48.1072 | 62.2989 | 44.1299 | 54.9008 | 33.2689 | 38.313 |
| 206910_x_at | 192 | 65.2935 | 87.1984 | 44.3021 | 57.3976 | 44.4565 | 56.8325 | 52.1435 | 70.0334 | 59.3275 | 79.6821 |
| 201190_s_at | 193 | 99.4714 | 136.944 | 135.441 | 170.01 | 122.47 | 192.752 | 152.633 | 195.553 | 139.17 | 190.34 |
| 200629_at | 194 | 65.6188 | 96.7173 | 97.9007 | 128.356 | 117.844 | 136.606 | 136.388 | 203.732 | 89.6691 | 133.504 |
| 203913_s_at | 195 | 99.1825 | 119.125 | 133.028 | 174.487 | 107.696 | 148.935 | 109.397 | 156.829 | 105.528 | 170.279 |
| 202368_s_at | 196 | 24.4828 | 33.301 | 21.7919 | 26.2601 | 20.9291 | 30.8374 | 21.3356 | 31.4342 | 23.3183 | 33.9945 |
| 216231_s_at | 197 | 5078.69 | 7929.43 | 6878.7 | 8542.14 | 6336.8 | 8855.68 | 7673.6 | 9721.68 | 5618.93 | 8572.12 |
| 210514_x_at | 198 | 657.007 | 809.91 | 572.027 | 790.559 | 447.01 | 687.674 | 683.779 | 1083.01 | 327.349 | 413.751 |
| 221485_at | 199 | 72.3997 | 98.7293 | 110.816 | 138.313 | 99.8732 | 149.123 | 91.089 | 145.426 | 106.283 | 140.554 |
| 202459_s_at | 200 | 20.7126 | 28.5783 | 34.4277 | 52.1232 | 31.2311 | 43.5277 | 31.2827 | 47.2587 | 25.505 | 36.3397 |
| 202295_s_at | 201 | 209.092 | 283.362 | 357.539 | 551.244 | 289.436 | 435.012 | 326.653 | 437.891 | 306.961 | 461.881 |
| 213832_at | 202 | 57.2637 | 85.4938 | 83.7229 | 116.111 | 81.5355 | 131.017 | 90.918 | 115.554 | 68.2067 | 103.425 |
| 204083_s_at | 203 | 167.644 | 288.872 | 263.194 | 315.297 | 276.155 | 429.725 | 208.284 | 308.964 | 241.661 | 358.318 |
| 209728_at | 204 | 18.4192 | 28.7326 | 104.456 | 135.06 | 193.863 | 288.099 | 447.82 | 721.274 | 21.319 | 32.9965 |

Figure 3B.5

| | | | | | | | | | |
|---|---|---|---|---|---|---|---|---|---|
| 202283_at | 205 | 350.422 | 637.925 | 532.739 | 665.655 | 551.951 | 913.448 | 617.287 | 914.536 | 513.806 | 712.246 |
| 202273_at | 206 | 38.2683 | 67.2852 | 43.9353 | 59.964 | 42.6319 | 61.4122 | 37.1687 | 66.5862 | 27.4318 | 36.5442 |
| 213369_at | 207 | 38.165 | 73.5393 | 76.4309 | 109.823 | 34.6658 | 53.75 | 69.3169 | 94.294 | 35.6179 | 53.9127 |
| 217739_s_at | 208 | 151.262 | 217.687 | 218.416 | 333.662 | 214.088 | 270.831 | 229.398 | 413.533 | 227.806 | 412.002 |
| 203963_at | 209 | 277.105 | 435.93 | 390.835 | 531.386 | 337.551 | 567.798 | 416.375 | 556.215 | 250.589 | 475.741 |
| 202075_s_at | 210 | 103.477 | 139.489 | 84.4044 | 130.198 | 138.452 | 235.52 | 122.587 | 225.037 | 84.6832 | 125.221 |
| 212829_at | 211 | 36.0512 | 58.6413 | 52.2642 | 68.1318 | 49 | 74.8666 | 47.757 | 92.3704 | 53.7672 | 86.6073 |
| 214459_x_at | 212 | 1757.24 | 2763.28 | 2615.74 | 3601.81 | 1917.28 | 3337.19 | 2830.92 | 4447.88 | 1533.81 | 2656.79 |
| 211795_s_at | 213 | 21.7491 | 39.8213 | 29.6443 | 45.1936 | 18.8494 | 35.8167 | 36.3006 | 47.5954 | 26.8315 | 41.4819 |
| 208070_s_at | 214 | 52.0814 | 91.9714 | 57.9179 | 80.3124 | 74.0548 | 111.972 | 55.3604 | 111.982 | 75.1689 | 113.238 |
| 211529_x_at | 215 | 420.823 | 736.345 | 590.989 | 770.733 | 371.07 | 773.527 | 745.372 | 1143.57 | 452.728 | 734.358 |
| 208894_at | 216 | 904.289 | 1321.91 | 685.535 | 1114.05 | 739.827 | 1541.28 | 1412.36 | 2355.06 | 573.417 | 881.894 |
| 205549_at | 217 | 53.5742 | 78.609 | 80.4025 | 115.002 | 80.6478 | 125.522 | 44.3792 | 86.5419 | 73.3409 | 148.17 |
| 32128_at | 218 | 65.0521 | 111.192 | 54.8617 | 82.5522 | 43.2357 | 94.3683 | 109.891 | 157.69 | 55.9116 | 90.6761 |
| 203765_at | 219 | 28.436 | 54.0512 | 27.1312 | 46.0419 | 41.6361 | 65.6384 | 41.8886 | 73.5309 | 49.9163 | 74.7415 |
| 208812_x_at | 220 | 1906.69 | 3566.35 | 2400.91 | 3653.65 | 2021.07 | 3315.7 | 3373.15 | 4632.63 | 1527.5 | 3246.88 |
| 221185_s_at | 221 | 5.85762 | 11.0501 | 11.9558 | 26.9739 | 18.6335 | 29.4507 | 11.4373 | 16.8443 | 9.66831 | 15.5408 |
| 201666_at | 222 | 156.771 | 214.225 | 185.426 | 268.638 | 150.32 | 307.348 | 185.97 | 392.657 | 158.221 | 296.555 |
| 210102_at | 223 | 16.4339 | 39.7129 | 24.7093 | 36.274 | 23.6897 | 41.0181 | 23.7941 | 43.9363 | 26.503 | 40.3852 |
| 201137_s_at | 224 | 504.49 | 800.616 | 581.218 | 946.476 | 441.152 | 1029.65 | 781.665 | 1531.78 | 569.896 | 915.731 |
| 208146_s_at | 225 | 40.2449 | 77.8513 | 52.2319 | 80.9291 | 45.5219 | 103.914 | 92.6882 | 164.284 | 54.3952 | 85.5331 |
| 212464_s_at | 226 | 140.159 | 307.447 | 178.227 | 279.61 | 190.322 | 335.954 | 141.906 | 328.055 | 199.576 | 283.135 |
| 211548_s_at | 227 | 51.5042 | 127.729 | 115.348 | 203.196 | 77.3377 | 137.504 | 91.7674 | 151.158 | 93.2931 | 146.849 |
| 211896_s_at | 228 | 1764.14 | 3978.56 | 2438.54 | 3675.98 | 2638.18 | 5066.72 | 2304.69 | 5340.76 | 1559.89 | 2362.46 |
| 212230_at | 229 | 282.468 | 660.099 | 230.446 | 358.58 | 320.458 | 554.65 | 244.797 | 577.357 | 308.645 | 496.512 |
| 218795_at | 230 | 42.2441 | 75.4431 | 209.36 | 502.714 | 105.207 | 157.769 | 140.725 | 226.428 | 104.633 | 256.112 |
| 211991_s_at | 231 | 416.413 | 922.994 | 474.261 | 837.986 | 406.128 | 919.639 | 908.003 | 1736.68 | 301.195 | 550.94 |
| 202531_at | 232 | 24.5586 | 50.0136 | 18.8965 | 31.7141 | 22.0091 | 67.013 | 43.9736 | 88.33 | 20.7901 | 33.4094 |
| 209708_at | 233 | 26.5345 | 53.9436 | 40.2292 | 82.0506 | 44.2352 | 89.3452 | 42.4031 | 76.508 | 35.2382 | 84.7997 |
| 212558_at | 234 | 37.2932 | 65.5317 | 26.5224 | 49.4544 | 31.8545 | 82.7943 | 63.9439 | 171.28 | 54.0438 | 86.7502 |
| 213293_s_at | 235 | 43.305 | 109.171 | 50.9466 | 87.4845 | 67.9759 | 124.147 | 95.7477 | 260.74 | 86.8238 | 150.412 |
| 213975_s_at | 236 | 404.977 | 849.639 | 253.167 | 520.558 | 196.681 | 612.639 | 385.564 | 842.585 | 278.907 | 599.647 |
| 201069_at | 237 | 172.276 | 398.774 | 277.594 | 424.423 | 239.052 | 666.921 | 237.143 | 548.31 | 180.28 | 527.289 |
| 214536_at | 238 | 112.023 | 208.509 | 162.607 | 322.357 | 151.744 | 623.881 | 111.004 | 258.925 | 63.8824 | 213.28 |
| 212224_at | 239 | 32.4822 | 140.059 | 104.152 | 236.932 | 70.5792 | 178.137 | 119.294 | 255.883 | 118.12 | 268.792 |
| 202768_at | 240 | 63.8927 | 162.786 | 43.5596 | 182.281 | 72.7254 | 176.853 | 85.9119 | 275.636 | 18.5059 | 71.4035 |
| 205337_at | 241 | 79.8466 | 611.924 | 310.866 | 693.907 | 162.035 | 544.493 | 327.935 | 955.056 | 140.509 | 557.771 |
| 212187_x_at | 242 | 265.294 | 1320.76 | 393.368 | 1081.87 | 575.627 | 2833.91 | 382.004 | 3235.15 | 410.881 | 975.257 |
| 217232_x_at | 243 | 387.52 | 1551.09 | 69.4695 | 727.678 | 66.1652 | 1017.44 | 41.7785 | 804.679 | 102.423 | 1624.83 |
| 211696_x_at | 244 | 526.589 | 2268.82 | 77.8905 | 944.719 | 53.1332 | 1452.75 | 43.3874 | 1108.63 | 104.657 | 2184.54 |
| 211699_x_at | 245 | 304.273 | 1959.63 | 66.8581 | 642.719 | 28.4634 | 1151.04 | 29.762 | 852.074 | 38.3692 | 669.033 |
| 204018_x_at | 246 | 735.822 | 4782.48 | 202.05 | 1922.52 | 99.2893 | 2864.77 | 58.7838 | 2331.02 | 97.4064 | 2014.84 |

Figure 3B.6

| | | | | | | | | | |
|---|---|---|---|---|---|---|---|---|---|
| 209458_x_at | 247 | 493.711 | 3178.74 | 147.388 | 1485.59 | 69.1346 | 2090.8 | 36.2557 | 1643.39 | 73.5797 | 1398.97 |
| 211745_x_at | 248 | 607.929 | 4058.53 | 153.989 | 1537.12 | 76.8874 | 2341.83 | 51.726 | 1955.87 | 77.046 | 1912.99 |
| 217414_x_at | 249 | 499.295 | 3518.17 | 106.927 | 1130.81 | 51.1172 | 1992.22 | 39.0018 | 1496.41 | 62.0654 | 1425.23 |
| 214414_x_at | 250 | 556.24 | 3792.44 | 135.008 | 1559.46 | 97.2593 | 2445.31 | 34.3356 | 1788.14 | 100.479 | 2811.35 |
| 209116_x_at | 251 | 386.244 | 2038.18 | 63.2564 | 920.314 | 39.7247 | 1400.57 | 34.8729 | 1347.71 | 42.8708 | 2135.56 |

Figure 3B.7

| Systematic | SEQ ID No. | Transcript ID Affyn | Alignments_Affymetrix | Gene Title_Affymetrix |
|---|---|---|---|---|
| 220970_s_at | 1 | Hs.900151.206 | chr17:39594550-39594867 (-) | |
| 207787_at | 2 | Hs.32950.0 | chr17:39892921-39893332 (-) | keratin, hair, acidic, 3B |
| 220972_s_at | 3 | Hs.900150.202 | chr17:39785314-39785744 (+) | |
| 206969_at | 4 | Hs.296942.0 | chr17:39907217-39907537 (-) | keratin, hair, acidic, 4 |
| 208483_x_at | 5 | Hs.197874.0 | chr17:39875537-39876342 (-) | keratin, hair, acidic, 3A |
| 220976_s_at | 6 | Hs.900145.185 | chr17:39570069-39570295 (-) | keratin associated protein 1-1 |
| 220978_at | 7 | Hs.900144.193 | chr17:39563346-39563739 (-) | keratin associated protein 1-3 |
| 206677_at | 8 | Hs.41696.0 | chr17:39923198-39923447 (-) | keratin, hair, acidic, 1 |
| 221297_at | 9 | Hs.283073.0 | chr17:12984987-12994100 (-) | G protein-coupled receptor, fam C, grp 5, mem D |
| 213711_at | 10 | Hs.32952.0 | chr12:509660039-509666462 (-) | keratin, hair, basic, 1 |
| 215189_at | 11 | Hs.278658.0 | chr12:50988684-50989189 (+) | keratin, hair, basic, 6 (monilethrix) |
| 206423_at | 12 | Hs.146559.0 | chr11:10965025-10965346 (+) | angiopoietin-like factor |
| 207457_s_at | 13 | Hs.241587.0 | chr6:31787564-31789921 (+) | lymphocyte antigen 6 complex, locus G6D |
| 216810_at | 14 | Hs.307020.0 | chr17:39614184-39614559 (+) | keratin associated protein 4-7 |
| 216921_s_at | 15 | Hs.73082.1 | chr17:40006124-40006540 (-) | keratin, hair, acidic, 5 |
| 207669_at | 16 | Hs.182506.0 | chr12:50994402-50994765 (-) | keratin, hair, basic, 3 |
| 206027_at | 17 | Hs.2961.0 | chr1_random:4946283-4947336 (-) | S100 calcium binding protein A3 |
| 205713_s_at | 18 | Hs.1584.0 | chr19:18754719-18756765 (-) | cartilage oligomeric matrix protein |
| 207670_at | 19 | Hs.182507.0 | chr12:51040096-51040584 (-) | keratin, hair, basic, 5 |
| 207146_at | 20 | Hs.41752.0 | chr17:39989258-39992394 (-) | keratin, hair, acidic, 2 |
| 220635_at | 21 | Hs.146824.0 | chr6:31211613-31212155 (-) | psoriasis susceptibility 1 candidate 2 |
| 213880_at | 22 | Hs.285529.1 | chr12:70265772-70266237 (+) | G protein-coupled receptor 49 |
| 206987_x_at | 23 | Hs.49585.0 | chr5:170864518-170865012 (+) | fibroblast growth factor 18 |
| 211029_x_at | 24 | Hs.900945.496 | chr5:170864518-170865015 (+) | fibroblast growth factor 18 |
| 207065_at | 25 | Hs.145949.0 | chr12:51104195-51104668 (-) | cytokeratin type II |
| 202833_s_at | 26 | Hs.297681.0 | chr14:92835948-92837431 (-) | serine (or cysteine) proteinase inhibitor, clade A (alpha-1 antiproteinase, antitrypsin), member 1 |
| 208092_s_at | 27 | Hs.900068.125 | chr2:16718449-16725342 (-) | hypothetical protein DKFZp566A1524 |
| 213780_at | 28 | Hs.82276.0 | chr1:149295447-149295972 (-) | Homo sapiens trichohyalin (THH), mRNA |
| 213909_at | 29 | Hs.288467.0 | chr3:195395532-195396048 (-) | carboxypeptidase N, polypeptide 2, 83kD |
| 204687_at | 30 | Hs.105460.0 | chr4:76430339-76430851 (+) | DKFZP564O0823 protein |
| 219932_at | 31 | Hs.49765.0 | chr5:128439091-128445150 (+) | solute carrier family 27 (fatty acid transporter), member 6 |
| 222351_at | 32 | Hs.168737.0 | chr11:111135323-111145943 (-) | protein phosphatase 2 (formerly 2A), regulatory subunit A (PR 65), beta isoform |
| 218935_at | 33 | Hs.87125.0 | chr2:31465258-31465751 (+) | EH-domain containing 3 |
| 203304_at | 34 | Hs.78776.0 | chr10:28975104-28975653 (+) | putative transmembrane protein |
| 209800_at | 35 | Hs.115947.0 | chr17:40139617-40140350 (-) | keratin 16 (focal non-epidermolytic palmoplantar keratoderma) |

Figure 3C.1

| Probe | # | Hs | Location | Description |
|---|---|---|---|---|
| 209343_at | 36 | Hs.24391.0 | chr2:233749462-233749906 (+) | likely ortholog of neuronally expressed calcium binding protein |
| 220272_at | 37 | Hs.103853.0 | chr9:16408581-16409072 (-) | hypothetical protein FLJ20043 |
| 212915_at | 38 | Hs.177635.0 | chr3:73352613-73353127 (-) | likely ortholog of mouse semaF cytoplasmic domain associated protein 3 |
| 221558_s_at | 39 | Hs.44865.1 | chr4:109427582-109428025 (-) | lymphoid enhancer-binding factor 1 |
| 203921_at | 40 | Hs.8786.0 | chr3:144162174-144162647 (+) | carbohydrate (N-acetylglucosamine-6-O) sulfotransferase 2 |
| 205290_s_at | 41 | Hs.73853.0 | chr20:6754172-6754667 (+) | bone morphogenetic protein 2 |
| 202376_at | 42 | Hs.234726.0 | chr14:93078768-93080392 (+) | serine (or cysteine) proteinase inhibitor, clade A (alpha-1 antiproteinase, antitrypsin), member 3 |
| 210393_at | 43 | Hs.285529.0 | chr12:70264350-70264786 (-) | G protein-coupled receptor 49 |
| 37892_at | 44 | 4876385 | chr10:102806049-102806446 (-) | collagen, type XI, alpha 1 |
| 206140_at | 45 | Hs.1569.0 | chr9:122171195-122171381 (+) | LIM homeobox 2 |
| 201109_s_at | 46 | Hs.87409.0 | chr15:37604193-37604749 (-) | thrombospondin 1 |
| 202886_s_at | 47 | Hs.108705.0 | chr11:111149543-111149881 (-) | protein phosphatase 2 (formerly 2A), regulatory subunit A (PR 65), beta isoform |
| 205374_at | 48 | Hs.15219.0 | chr11:107115857-107116397 (-) | sarcolipin |
| 219250_s_at | 49 | Hs.41296.0 | chr20:14300829-14301357 (-) | fibronectin leucine rich transmembrane protein 3 |
| 219832_s_at | 50 | Hs.118608.0 | chr12:52626047-52626476 (+) | homeo box C13 |
| 202883_s_at | 51 | Hs.108705.0 | chr11:111147594-111148055 (-) | protein phosphatase 2 (formerly 2A), regulatory subunit A (PR 65), beta isoform |
| 209921_at | 52 | Hs.6682.1 | chr4:139662955-139663280 (-) | solute carrier family 7, (cationic amino acid transporter, y+ system) member 11 |
| 211071_s_at | 53 | Hs.901103.278 | chr1:148257063-148257528 (+) | ALL1-fused gene from chromosome 1q |
| 216603_at | 54 | Hs.22891.3 | chr14:216625680-216625802 (+) | solute carrier family 7 (cationic amino acid transporter, y+ system), member 8 |
| 211219_s_at | 55 | Hs.1569.1 | chr9:122159537-122171155 (+) | LIM homeobox 2 |
| 202016_at | 56 | Hs.79284.0 | chr7:129698549-129699017 (+) | mesoderm specific transcript homolog (mouse) |
| 215034_s_at | 57 | Hs.306643.0 | chr3:150408395-150408573 (-) | transmembrane 4 superfamily member 1 |
| 202884_s_at | 58 | Hs.108705.0 | chr11:111149930-111160566 (-) | protein phosphatase 2 (formerly 2A), regulatory subunit A (PR 65), beta isoform |
| 206315_at | 59 | Hs.114948.0 | chr19:18565139-18566155 (-) | cytokine receptor-like factor 1 |
| 209286_at | 60 | Hs.260024.0 | chr2:37845792-37846247 (-) | CDC42 effector protein (Rho GTPase binding) 3 |
| 203980_at | 61 | Hs.83213.0 | chr8:82440957-82445362 (-) | fatty acid binding protein 4, adipocyte |
| 210319_x_at | 62 | Hs.89404.1 | chr5:174138266-174138672 (+) | msh homeo box homolog 2 (Drosophila) |
| 204351_at | 63 | Hs.2962.0 | chr4:6760183-6763412 (+) | S100 calcium binding protein P |
| 212154_at | 64 | Hs.1501.0 | chr8:97571204-97578382 (+) | syndecan 2 (heparan sulfate proteoglycan 1, cell surface-associated, fibroglycan) |
| 202391_at | 65 | Hs.79516.0 | chr5:173229003-173229444 (+) | brain abundant, membrane attached signal prot 1 |
| 214036_at | 66 | Hs.27342.0 | chr5:106789969-106789281 (-) | Homo sap cDNA: FLJ22256 fis, clone HRC02860 |

Figure 3C.2

| | | | |
|---|---|---|---|
| 209288_s_at | 67 | Hs.260024.0 | chr2:37846539-37846987 (-) | CDC42 effector protein (Rho GTPase binding) 3 |
| 213100_at | 68 | Hs.13350.0 | chr10:72406651-72407178 (+) | unc-5 homolog B (C. elegans) |
| 215785_s_at | 69 | Hs.258503.2 | chr5:156800734-156801104 (+) | cytoplasmic FMR1 interacting protein 2 |
| 200906_s_at | 70 | Hs.194431.0 | chr4:170541348-170543486 (+) | palladin |
| 205932_s_at | 71 | Hs.1494.0 | chr4:4929551-4929811 (+) | msh homeo box homolog 1 (Drosophila) |
| 205289_at | 72 | Hs.73853.0 | chr20:6755113-6755582 (+) | bone morphogenetic protein 2 |
| 216092_s_at | 73 | Hs.22891.4 | chr14:21584669-21585207 (-) | solute carrier family 7 (cationic amino acid transporter, y+ system), member 8 |
| 210074_at | 74 | Hs.87417.0 | chr9:95174984-95177780 (-) | cathepsin L2 |
| 213556_at | 75 | Hs.22049.0 | chr19:48777323-48778043 (+) | Homo sap cDNA FLJ26039 fis, clone PRS00963 |
| 203797_at | 76 | Hs.2288.0 | chr2:17821497-17821756 (+) | visinin-like 1 |
| 219229_at | 77 | Hs.14805.0 | chr15:90435984-90436482 (+) | solute carrier organic anion transporter family, member 3A1 |
| 202166_s_at | 78 | Hs.267819.0 | chr3:196562825-196563249 (-) | protein phosphatase 1, regulatory (inhibitor) subunit 2 |
| 204256_at | 79 | Hs.211556.0 | chr4:111429389-111429490 (-) | ELOVL family member 6, elongation of long chain fatty acids (FEN1/Elo2, SUR4/Elo3-like, yeast) |
| 202693_s_at | 80 | Hs.9075.0 | chr7:43404983-43405495 (+) | serine/threonine kinase 17a (apoptosis-inducing) |
| 205472_s_at | 81 | Hs.63931.0 | chr13:69812233-69812628 (-) | dachshund homolog (Drosophila) |
| 203798_s_at | 82 | Hs.2288.0 | chr2:17815323-17821350 (+) | visinin-like 1 |
| 202363_at | 83 | Hs.93029.0 | chr5:136387302-136387798 (-) | sparc/osteonectin, cwcv and kazal-like domains proteoglycan (testican) |
| 200730_s_at | 84 | Hs.227777.0 | chr6:64287036-64287447 (+) | protein tyrosine phosphatase type IVA, member 1 |
| 204141_at | 85 | Hs.179661.0 | chr6:3098945-3099112 (-) | tubulin, beta polypeptide |
| 202436_s_at | 86 | Hs.154654.0 | chr2:382699988-38270417 (-) | cytochrome P450, fam 1, subfamily B, polypep 1 |
| 208637_x_at | 87 | Hs.119000.1 | chr14:67331454-67335809 (-) | actinin, alpha 1 |
| 204682_at | 88 | Hs.83337.0 | chr14:729566539-729956904 (-) | latent transforming growth factor beta binding protein 2 |
| 203574_at | 89 | Hs.79334.0 | chr9:89512814-89513311 (-) | nuclear factor, interleukin 3 regulated |
| 214104_at | 90 | Hs.301642.1 | chr1:165241916-165244263 (-) | G protein-coupled receptor 161 |
| 201105_at | 91 | Hs.227751.0 | chr22:36316016-36318770 (+) | lectin, galactoside-binding, soluble, 1 (galectin 1) |
| 209126_x_at | 92 | Hs.111758.0 | chr12:51127332-51128034 (-) | keratin 6B |
| 213135_at | 93 | Hs.82141.0 | chr21:31411319-31411660 (-) | T-cell lymphoma invasion and metastasis 1 |
| 200907_s_at | 94 | Hs.194431.0 | chr4:170544378-170544816 (+) | palladin |
| 217933_s_at | 95 | Hs.182579.0 | chr11:173359917-17360451 (+) | leucine aminopeptidase 3 |
| 217897_at | 96 | Hs.3807.0 | chr11:117245382-117245867 (-) | FXYD domain containing ion transport regulator 6 |
| 201266_at | 97 | Hs.13046.0 | chr12:103245960-103246433 (+) | thioredoxin reductase 1 |
| 215253_s_at | 98 | Hs.250724.0 | chr21:34814199-34814346 (-) | Down syndrome critical region gene 1 |
| 201286_at | 99 | Hs.82109.0 | chr2:20385110-20385598 (-) | syndecan 1 |
| 209772_s_at | 100 | Hs.286124.0 | chrY:200049453-20049799 (-) | CD24 antigen (small cell lung carcinoma cluster 4 antigen) |

Figure 3C.3

| Probe ID | # | Hs ID | Location | Description |
|---|---|---|---|---|
| 221881_s_at | 101 | Hs.25035.1 | chr1:24491789-24518594 (+) | chloride intracellular channel 4 |
| 201616_s_at | 102 | Hs.325474.0 | chr7:134066167-134069562 (+) | caldesmon 1 |
| 209283_at | 103 | Hs.1940.0 | chr11:111317078-111320025 (-) | crystallin, alpha B |
| 37408_at | 104 | Hs.4902565_RC | chr17:61243740-61244327 (+) | mannose receptor, C type 2 |
| 200897_s_at | 105 | Hs.194431.0 | chr4:170544972-170545353 (+) | palladin |
| 208636_at | 106 | Hs.119000.1 | chr14:67330913-67331336 (-) | actinin, alpha 1 |
| 208708_x_at | 107 | Hs.286236.1 | chr14:101796150-101797624 (+) | eukaryotic translation initiation factor 5 |
| 205157_s_at | 108 | Hs.2785.0 | chr17:40149952-40150464 (-) | keratin 17 |
| 204029_at | 109 | Hs.57652.0 | chr1:109116566-109116998 (+) | cadherin, EGF LAG seven-pass G-type receptor 2 (flamingo homolog, Drosophila) |
| 200644_at | 110 | Hs.750610 | chr1:32301997-32302472 (-) | MARCKS-like protein |
| 210987_x_at | 111 | Hs.77899.2 | chr15:61079181-61079625 (+) | |
| 201397_at | 112 | Hs.3343.0 | chr1:119631834-119633190 (+) | phosphoglycerate dehydrogenase |
| 202936_s_at | 113 | Hs.2316.0 | chr17:70719098-70719613 (+) | SRY (sex determining region Y)-box 9 (campomelic dysplasia, autosomal sex-reversal) |
| 41856_at | 114 | Hs.4863220_RC | chr10:72406671-72406981 (+) | unc-5 homolog B (C. elegans) |
| 202066_at | 115 | Hs.183648.0 | chr11:69956447-69956746 (+) | protein tyrosine phosphatase, receptor type, f polypeptide (PTPRF), interacting protein (liprin), alpha 1 |
| 201841_s_at | 116 | Hs.76067.0 | chr7:75544444-75545397 (+) | heat shock 27kDa protein 1 |
| 209099_x_at | 117 | Hs.91143.0 | chr20:10613671-10614175 (-) | jagged 1 (Alagille syndrome) |
| 214590_s_at | 118 | Hs.318435.0 | chr10:59473101-59473593 (+) | ubiquitin-conjugating enzyme E2D 1 (UBC4/5 homolog, yeast) |
| 205125_at | 119 | Hs.80776.0 | chr3:38009664-38010410 (-) | phospholipase C, delta 1 |
| 203585_at | 120 | Hs.16622.0 | chrX:150759046-150759555 (+) | zinc finger protein 185 (LIM domain) |
| 203367_at | 121 | Hs.91448.0 | chr7:36068594-36069118 (+) | dual specificity phosphatase 14 |
| 204255_s_at | 122 | Hs.2062.0 | chr12:46522821-46523284 (+) | vitamin D (1,25- dihydroxyvitamin D3) receptor |
| 211383_s_at | 123 | Hs.27207.1 | chr10:1131542-1132066 (+) | KIAA0982 protein |
| 212426_s_at | 124 | Hs.74405.1 | chr2:9745888-9746110 (-) | tyrosine 3-monooxygenase/tryptophan 5-monooxygenase activation protein, theta polypeptide |
| 213072_at | 125 | Hs.331601.0 | chr8:145680151-145680698 (-) | hypothetical protein MGC13010 |
| 204761_at | 126 | Hs.278526.0 | chr11:115066697-115072130 (-) | USP6 N-terminal like |
| 202949_s_at | 127 | Hs.8302.0 | chr2:105598719-105599251 (-) | four and a half LIM domains 2 |
| 210986_s_at | 128 | Hs.77899.1 | chr15:61079727-61079865 (+) | tropomyosin 1 (alpha) |
| 214749_s_at | 129 | Hs.83530.1 | chrX:99625359-99625477 (+) | hypothetical protein FLJ20811 |
| 200924_s_at | 130 | Hs.79748.0 | chr1:62430963-62431500 (+) | solute carrier family 3 (activators of dibasic and neutral amino acid transport), member 2 |
| 202570_s_at | 131 | Hs.177425.0 | chr20:35814390-35840873 (+) | disks large-associated protein 4 |
| 209859_at | 132 | Hs.75090.0 | chr14:49432070-49432599 (-) | tripartite motif-containing 9 |
| 213134_x_at | 133 | Hs.77311.1 | chr21:17887949-17888384 (-) | BTG family, member 3 |
| 208949_s_at | 134 | Hs.621.0 | chr14:53595004-53602025 (+) | lectin, galactoside-binding, soluble, 3 (galectin 3) |

Figure 3C.4

| | | | |
|---|---|---|---|
| 202345_s_at | 135 | Hs.153179.0 | chr1:59324064-59324532 (-) | fatty acid binding protein 5 (psoriasis-associated) |
| 214004_s_at | 136 | Hs.79025.1 | chr3:11574968-11575295 (-) | KIAA0121 gene product |
| 209344_at | 137 | Hs.250641.0 | chr19:16073606-16073831 (+) | tropomyosin 4 |
| 212365_at | 138 | Hs.121576.0 | chr2:192481786-192491278 (+) | myosin IB |
| 205372_at | 139 | Hs.14968.0 | chr8:57123486-57124013 (-) | pleiomorphic adenoma gene 1 |
| 204361_s_at | 140 | Hs.52644.0 | chr7:26451407-26472251 (-) | src family associated phosphoprotein 2 |
| 200824_at | 141 | Hs.226795.0 | chr11:67127375-67129324 (+) | glutathione S-transferase pi |
| 209427_at | 142 | Hs.149098.1 | chr22:29821449-29821550 (+) | smoothelin |
| 200839_s_at | 143 | Hs.297939.0 | chr8:11739309-11739612 (-) | cathepsin B |
| 36564_at | 144 | 4874156 | chr21:22448080-22448149 (-) | hypothetical protein FLJ90005 |
| 203423_at | 145 | Hs.101850.0 | chr3:140557243-140579283 (-) | retinol binding protein 1, cellular |
| 210493_s_at | 146 | Hs.285318.0 | chr4:171622654-171622811 (-) | KIAA0626 gene product |
| 209442_x_at | 147 | Hs.75893.2 | chr10:61134090-61160381 (-) | ankyrin 3, node of Ranvier (ankyrin G) |
| 201820_at | 148 | Hs.195850.0 | chr12:51194657-51195206 (-) | keratin 5 (epidermolysis bullosa simplex, Dowling-Meara/Kobner/Weber-Cockayne types) |
| 205732_s_at | 149 | Hs.29131.0 | chr8:71074310-71074809 (-) | nuclear receptor coactivator 2 |
| 38340_at | 150 | 4877717_RC | chr12:121784678-121785010 (+) | huntingtin interacting protein-1-related |
| 201485_s_at | 151 | Hs.79088.0 | chr15:74955646-74957505 (+) | reticulocalbin 2, EF-hand calcium binding domain |
| 218032_at | 152 | Hs.76691.0 | chr16:117738871-117739387 (-) | stannin /// stannin |
| 214116_at | 153 | Hs.78885.1 | chr3:15658574-15658729 (+) | biotinidase |
| 201131_s_at | 154 | Hs.194657.0 | chr16:68645053-68645535 (-) | cadherin 1, type 1, E-cadherin (epithelial) |
| 211995_x_at | 155 | Hs.14376.9 | chr17:80177427-80177956 (-) | actin, gamma 1 |
| 220768_s_at | 156 | Hs.129206.0 | chr5:123026853-123027308 (+) | casein kinase 1, gamma 3 |
| 213811_x_at | 157 | Hs.101047.4 | chr19:1561989-1562557 (-) | transcription factor 3 (E2A immunoglobulin enhancer binding factors E12/E47) |
| 209351_at | 158 | Hs.117729.0 | chr17:40111709-40111950 (-) | keratin 14 (epidermolysis bullosa simplex, Dowling-Meara, Koebner) |
| 212363_x_at | 159 | Hs.14376.7 | chr17:80177382-80177956 (-) | actin, gamma 1 |
| 209014_at | 160 | Hs.177556.0 | chrX:50561479-50562218 (+) | melanoma antigen, family D, 1 |
| 202150_s_at | 161 | Hs.80261.0 | chr6:109047073-109047492 (+) | neural precursor cell expressed, developmentally down-regulated 9 |
| 204131_s_at | 162 | Hs.14845.0 | chr11:29293398-11293839 (-) | Homo sapiens cDNA clone IMAGE:4814010, partial cds |
| 212971_at | 163 | Hs.159604.1 | chr11:2986503-2986582 (-) | cysteinyl-tRNA synthetase |
| 212741_at | 164 | Hs.183109.1 | chrX:42651485-42651959 (+) | monoamine oxidase A |
| AFFX-HSAC07/ | 165 | AFFX-HSAC07/X00 | chr7:5311146-5311685 (-) | actin, beta |
| 209408_at | 166 | Hs.69360.1 | chr1:44646160-44646587 (+) | kinesin family member 2C |
| 205745_x_at | 167 | Hs.64311.0 | chr2:9651187-9651681 (-) | a disintegrin and metalloproteinase domain 17 (tumor necrosis factor, alpha, converting enzyme) |
| 210160_at | 168 | Hs.93354.0 | chr11:116576832-116576385 (+) | platelet-activating factor acetylhydrolase, isoform Ib, beta subunit 30kDa |

Figure 3C.5

| | | | | |
|---|---|---|---|---|
| 202706_s_at | 169 | Hs.2057.0 | chr3:125779785-125783840 (+) | uridine monophosphate synthetase (orotate phosphoribosyl transferase and orotidine-5'-decarboxylase) |
| 212087_s_at | 170 | Hs.3426.0 | chr17:27333013-27333554 (+) | Era G-protein-like 1 (E. coli) |
| 214011_s_at | 171 | Hs.279918.1 | chr5:175791944-175794835 (-) | hypothetical protein HSPC111 |
| 208959_s_at | 172 | Hs.154023.0 | chr9:98124676-98149788 (-) | thioredoxin domain containing 4 (endoplasmic reticulum) |
| 203405_at | 173 | Hs.5198.0 | chr21:39467866-39470937 (-) | Down syndrome critical region gene 2 |
| 214527_s_at | 174 | Hs.30570.4 | chrX:47801808-47806313 (+) | polyglutamine binding protein 1 |
| 219770_at | 175 | Hs.62348.0 | chr2:144914468-144914946 (-) | hypothetical protein FLJ11753 |
| 213136_at | 176 | Hs.82829.1 | chr18:127775519-127775845 (-) | protein tyr phosphatase, non-receptor type 2 |
| 203501_at | 177 | Hs.197335.0 | chr8:98112005-98112251 (+) | plasma glutamate carboxypeptidase |
| 219503_s_at | 178 | Hs.16740.0 | chr3:127750555-127750996 (-) | hypothetical protein FLJ11036 |
| 218992_at | 179 | Hs.181385.0 | chr9:5348009-5351844 (-) | chromosome 9 open reading frame 46 |
| 220052_s_at | 180 | Hs.7797.0 | chr14:22699281-22699581 (-) | TERF1 (TRF1)-interacting nuclear factor 2 |
| 215460_x_at | 181 | Hs.127950.1 | chr22:48386298-48386782 (-) | bromodomain containing 1 |
| 203505_at | 182 | Hs.211562.0 | chr9:102923308-102923606 (-) | ATP-binding cassette, sub-family A (ABC1), member 1 |
| 207543_s_at | 183 | Hs.76768.0 | chr10:74111699-74112181 (-) | procollagen-proline, 2-oxoglutarate 4-dioxygenase (proline 4-hydroxylase), alpha polypept I |
| 218418_s_at | 184 | Hs.284208.0 | chr19:11136028-11136524 (-) | KIAA1518 protein |
| 204440_at | 185 | Hs.79197.0 | chr6:14244500-14245050 (+) | CD83 antigen (activated B lymphocytes, immunoglobulin superfamily) |
| 220942_x_at | 186 | Hs.5243.0 | chr3:123444005-123449806 (+) | growth and transformation-dependent protein |
| 218280_x_at | 187 | Hs.795.0 | chr1:147039225-147039716 (+) | histone 2, H2aa |
| 208717_at | 188 | Hs.151134.0 | chr14:21230198-21230938 (+) | oxidase (cytochrome c) assembly 1-like |
| 212706_at | 189 | Hs.184367.0 | chr7:101780803-101781215 (-) | DNA directed RNA polymerase II polypeptide J-related gene |
| 218119_at | 190 | Hs.283684.0 | chr10:50719009-50732348 (+) | translocase of inner mitochondrial membrane 23 homolog (yeast) |
| 206686_s_at | 191 | Hs.83341.1 | chr19:46458931-46459473 (+) | AXL receptor tyrosine kinase |
| 206910_x_at | 192 | Hs.154224.0 | chr1:194208371-194216569 (+) | H factor (complement)-like 3 |
| 201190_s_at | 193 | Hs.79709.0 | chr17:16279411-16288264 (-) | phosphotidylinositol transfer protein |
| 200629_at | 194 | Hs.82030.0 | chr14:98790223-98790617 (-) | tryptophanyl-tRNA synthetase |
| 203913_s_at | 195 | Hs.77348.0 | chr4:176108164-176108616 (-) | hydroxyprostaglandin dehydrogenase 15-(NAD) |
| 202368_s_at | 196 | Hs.153954.0 | chr6:52412317-52412761 (-) | translocation associated membrane protein 2 |
| 216231_s_at | 197 | Hs.75415.2 | chr15:42719842-42723932 (+) | beta-2-microglobulin |
| 210514_x_at | 198 | Hs.73885.3 | chr6:29904455-29905679 (+) | HLA-G histocompatibility antigen, class I, G |
| 221485_at | 199 | Hs.107526.0 | chr20:48935035-48935389 (-) | UDP-Gal:betaGlcNAc beta 1,4-galactosyltransferase, polypeptide 5 |
| 202459_s_at | 200 | Hs.166318.0 | chr18:2907645-2908172 (-) | lipin 2 |

Figure 3C.6

| Probe | ID | Location | Description |
|---|---|---|---|
| 202295_s_at | 201 Hs.288181.0 | chr15:76929973-76931284 (-) | cathepsin H |
| 213832_at | 202 Hs.23729.0 | chr1:111612047-111612506 (-) | Homo sapiens clone 24405 mRNA sequence |
| 204083_s_at | 203 Hs.300772.0 | chr9:35674249-35675667 (-) | tropomyosin 2 (beta) |
| 209728_at | 204 Hs.318720.0 | chr6:32573305-32600653 (-) | MHC, class II, DR beta 3 |
| 202283_at | 205 Hs.173594.0 | chr17:1886422-1887391 (+) | serine (or cysteine) proteinase inhibitor, clade F (alpha-2 antiplasmin, pigment epithelium derived factor), member 1 |
| 202273_at | 206 Hs.76144.0 | chr5:149522012-149522524 (-) | platelet-derived growth factor receptor, beta polypeptide |
| 213369_at | 207 Hs.137556.0 | chr10:85641136-85641678 (+) | MT-protocadherin |
| 217739_s_at | 208 Hs.239138.0 | chr7:105451227-105451734 (-) | pre-B-cell colony-enhancing factor |
| 203963_at | 209 Hs.5338.0 | chr15:61332802-61333278 (-) | carbonic anhydrase XII |
| 202075_s_at | 210 Hs.283007.0 | chr20:45212853-45216516 (-) | phospholipid transfer protein |
| 212829_at | 211 Hs.57079.1 | chr10:22827937-22828497 (-) | Homo sapiens cDNA FLJ13267 fis, clone OVARC1000964. |
| 214459_x_at | 212 Hs.274485.0 | chr6:31341470-31342823 (-) | major histocompatibility complex, class I, C |
| 211795_s_at | 213 Hs.58435.1 | chr5:39153832-39169879 (-) | FYN binding protein (FYB-120/130) |
| 208070_s_at | 214 Hs.115521.0 | chr6:111665953-111666423 (-) | REV3-like, catalytic subunit of DNA polymerase zeta (yeast) |
| 211529_x_at | 215 Hs.73885.1 | chr6:29905228-29906586 (+) | HLA-G histocompatibility antigen, class I, G |
| 208894_at | 216 Hs.76807.0 | chr6:32482183-32482273 (+) | major histocompatibility complex, class II, DR alpha |
| 205549_at | 217 Hs.80296.0 | chr21:40159789-40221650 (+) | Purkinje cell protein 4 |
| 32128_at | 218 4864840_RC | chr17:34543418-34544329 (+) | chemokine (C-C motif) ligand 18 (pulmonary and activation-regulated) |
| 203765_at | 219 Hs.79381.0 | chr2:163419713-163420105 (+) | grancalcin, EF-hand calcium binding protein |
| 208812_x_at | 220 Hs.277477.0 | chr6:31341404-31342542 (-) | major histocompatibility complex, class I, C |
| 221185_s_at | 221 Hs.288693.0 | chr3:198942752-198943065 (-) | hypothetical protein DKFZp434B227 |
| 201666_at | 222 Hs.5831.0 | chrX:46490319-46491965 (+) | tissue inhibitor of metalloproteinase 1 (erythroid potentiating activity, collagenase inhibitor) |
| 210102_at | 223 Hs.152944.1 | chr11:123532688-123533165 (+) | loss of heterozygosity, 11, chromosomal region 2, gene A |
| 201137_s_at | 224 Hs.814.0 | chr6:33099702-33101363 (+) | major histocompatibility complex, class II, DP beta 1 |
| 208146_s_at | 225 Hs.900241.34 | chr7:28777646-28846096 (-) | carboxypeptidase, vitellogenic-like |
| 212464_s_at | 226 Hs.287820.1 | chr2:216428329-216428669 (-) | fibronectin 1 |
| 211548_s_at | 227 Hs.77348.1 | chr4:176107506-176107982 (-) | hydroxyprostaglandin dehydrogenase 15-(NAD) |
| 211896_s_at | 228 Hs.76152.3 | chr12:90047896-90049430 (-) | decorin |
| 212230_at | 229 Hs.173717.0 | chr1:56330398-56330936 (-) | phosphatidic acid phosphatase type 2B |
| 218795_at | 230 Hs.15871.0 | chr1:144626335-144631416 (-) | lysophosphatidic acid phosphatase |
| 211991_s_at | 231 Hs.914.0 | chr6:33083345-33083604 (-) | major histocompatibility complex, class II, DP alpha 1 |

Figure 3C.7

| | | | | |
|---|---|---|---|---|
| 202531_at | 232 | Hs.80645.0 | chr5:131895089-131895594 (-) | interferon regulatory factor 1 |
| 209708_at | 233 | Hs.6909.0 | chr6:132597818-132598324 (-) | monooxygenase, DBH-like 1 |
| 212588_at | 234 | Hs.170121.1 | chr1:196014045-196014543 (+) | protein tyrosine phosphatase, receptor type, C |
| 213293_s_at | 235 | Hs.295978.0 | chr11:5695714-5696227 (+) | tripartite motif-containing 22 |
| 213975_s_at | 236 | Hs.277431.0 | chr12:68033853-68034272 (+) | lysozyme (renal amyloidosis) |
| 201069_at | 237 | Hs.111301.0 | chr16:55318192-55318717 (+) | matrix metalloproteinase 2 (gelatinase A, 72kDa gelatinase, 72kDa type IV collagenase) |
| 214536_at | 238 | Hs.103505.0 | chr8:143885434-143886848 (-) | ARS component B |
| 212224_at | 239 | Hs.76392.0 | chr9:70973179-70984040 (-) | aldehyde dehydrogenase 1 family, member A1 |
| 202768_at | 240 | Hs.75678.0 | chr19:50669727-50670227 (+) | FBJ murine osteosarcoma viral oncogene homolog B |
| 205337_at | 241 | Hs.301865.0 | chr13:92787695-92788157 (-) | dopachrome tautomerase (dopachrome delta-isomerase, tyrosine-related protein 2) |
| 212187_x_at | 242 | Hs.8272.0 | chr9:135230810-135232029 (+) | prostaglandin D2 synthase 21kDa (brain) |
| 217232_x_at | 243 | Hs.155376.1 | chr11:5211215-5212543 (-) | --- |
| 211696_x_at | 244 | Hs.900626.610 | chr11:5211069-5212543 (-) | hemoglobin, beta /// hemoglobin, beta |
| 211699_x_at | 245 | Hs.900630.885 | chr16:162899-163603 (+) | hemoglobin, alpha 2 /// hemoglobin, alpha 2 |
| 204018_x_at | 246 | Hs.251577.0 | chr16:162882-163603 (+) | hemoglobin, alpha 2 |
| 209458_x_at | 247 | Hs.272572.0 | chr16:162899-163603 (+) | hemoglobin, alpha 2 |
| 211745_x_at | 248 | Hs.900772.977 | chr16:166726-167427 (+) | hemoglobin, alpha 2 /// hemoglobin, alpha 2 |
| 217414_x_at | 249 | Hs.272572.2 | chr16:162882-163617 (+) | --- |
| 214414_x_at | 250 | Hs.251577.1 | chr16:163317-163702 (+) | hemoglobin, alpha 2 |
| 209116_x_at | 251 | Hs.155376.0 | chr11:5211201-5212271 (-) | hemoglobin, beta |

Figure 3C.8

| SEQ ID No. | UniGene ID_Affymetrix | Ensembl_Affymetrix | OMIM Affymetrix | RefSeq Protein ID_Affymetrix | RefSeq Transcript ID_Affymetrix | Gene Ontology Biological Process_Affymetrix |
|---|---|---|---|---|---|---|
| 1 | | | | | | |
| 2 | Hs.329550 | ENSG00000131738 | 602762 | NP_002270 | NM_002279 | |
| 3 | | | | | | |
| 4 | Hs.296942 | ENSG00000131737 | 602763 | NP_066293 | NM_021013 | 8544 // epidermal differentiation // traceable author statement |
| 5 | Hs.512579 | ENSG00000006059 | 602761 | NP_004129 | NM_004138 | |
| 6 | Hs.247934 | ENSG00000131764 | | NP_112229 | NM_030967 | |
| 7 | Hs.247935 | ENSG00000131764 | | NP_112228 | NM_030966 | |
| 8 | Hs.41696 | ENSG00000094796 | 601077 | NP_002268 | NM_002277 | |
| 9 | Hs.283073 | ENSG00000111291 | 607437 | NP_061124 | NM_018654 | 7601 // vision // inferred from electronic annotation |
| 10 | Hs.170925 | ENSG00000123274 | 602153 | NP_002272 | NM_002281 | |
| 11 | Hs.278658 | ENSG00000170442 | 601928 | NP_002275 | NM_002284 | |
| 12 | Hs.146559 | ENSG00000171819 | | NP_066969 | NM_021146 | 6979 // response to oxidative stress // traceable author statement |
| 13 | Hs.408316 | ENSG00000096141 | 606038 | NP_067069 | NM_021246 | |
| 14 | Hs.380164 | ENSG00000182331 | | NP_149050 | NM_033061 | |
| 15 | Hs.73082 | ENSG00000126337 | 602764 | NP_002271 | NM_002280 | 9653 // morphogenesis // traceable author statement |
| 16 | Hs.182506 | ENSG00000170523 | | NP_002273 | NM_002282 | 8544 // epidermal differentiation // traceable author statement |
| 17 | Hs.433168 | ENSG00000169674 | 176992 | NP_002951 | NM_002960 | |
| 18 | Hs.1584 | | 600310 | NP_000086 | NM_000095 | |
| 19 | Hs.182507 | ENSG00000135443 | 602767 | NP_002274 | NM_002283 | 8544 // epidermal differentiation // traceable author statement |
| 20 | Hs.41752 | ENSG00000108759 | 602760 | NP_002269 | NM_002278 | 8544 // epidermal differentiation // traceable author statement |
| 21 | Hs.146824 | ENSG00000137311 | | NP_054788 | NM_014069 | |
| 22 | Hs.166705 | ENSG00000139292 | 506667 | NP_003658 /// NP_003853 | NM_003667 | 7186 // G-protein coupled receptor protein signaling pathway // traceable author statement |
| 23 | Hs.87191 | ENSG00000156427 | 603726 | NP_387498 /// NP_003853 | NM_003862 | see Addendum |
| 24 | Hs.87191 | ENSG00000156427 | 603726 | NP_387498 | NM_003862 | see Addendum |
| 25 | Hs.145949 | ENSG00000170454 | | NP_004684 | NM_004693 | |
| 26 | Hs.297681 | ENSG00000170086 | 107400 | NP_000286 | NM_000295 | 6953 // acute-phase response // inferred from electronic annotation |
| 27 | Hs.4863 | ENSG00000170762 | | NP_110424 | NM_030797 | |
| 28 | Hs.432416 | ENSG00000159450 | | | | |
| 29 | Hs.288467 | ENSG00000172061 | 603104 | | | |
| 30 | Hs.105460 | ENSG00000169116 | | NP_056208 | NM_015393 | |
| 31 | Hs.49765 | ENSG00000113396 | 604196 | NP_054750 /// NP_002707 | NM_014031 | 38 // very-long-chain fatty acid metabolism // traceable author statement /// 8152 // metabolism // inferred from electronic annotation |
| 32 | Hs.431156 | ENSG00000137713 | 603113 | NP_8590050 | NM_002716 | |
| 33 | Hs.368808 | ENSG00000113016 | 605891 | NP_055415 | NM_014600 | |
| 34 | Hs.348802 | ENSG00000095739 | 604444 | NP_036474 | NM_012342 | |
| 35 | Hs.432448 | ENSG00000186832 | 148067 | NP_005548 | NM_005557 | 8283 // cell proliferation // traceable author statement /// 8544 // epidermal differentiation // traceable author statement |
| 36 | Hs.269242 | ENSG00000115468 | | NP_079478 | NM_025202 | |
| 37 | Hs.103853 | | | | | 6118 // electron transport // inferred from electronic annotation |
| 38 | Hs.177635 | | | | | |
| 39 | Hs.44865 | ENSG00000138795 | 152245 | NP_057353 | NM_016269 | 6355 // regulation of transcription, DNA-dependent // inferred from electronic annotation |
| 40 | Hs.8786 | ENSG00000175040 | 603798 | NP_094258 | NM_004267 | |

Figure 3D.1

| | | | | |
|---|---|---|---|---|
| 41:Hs.73853 | ENSG00000125845 | 112261 NP_001191 | NM_001200 | see Addendum |
| 42:Hs.76353 | ENSG00000100665 | 107280 NP_001076 | NM_001085 | 6953 // acute-phase response // not recorded |
| 43:Hs.166705 | ENSG00000139292 | 606667 NP_003658 /// NP_001845 | NM_003667 | 7186 // G-protein coupled receptor protein signaling pathway // traceable author statement |
| 44:Hs.439168 | ENSG00000060718 | 120280 /// NP_542196 /// NP_542197 | NM_001854 /// see Addendum | |
| 45:Hs.1569 | ENSG00000106689 | 603759 NP_004780 | NM_004789 | 6355 // regulation of transcription, DNA-dependent // inferred from electronic annotation |
| 46:Hs.164226 | ENSG00000137801 | 188060 NP_003237 | NM_003246 | see Addendum |
| 47:Hs.431156 | ENSG00000137713 | 603113 /// NP_859050 /// NP_003054 | NM_002716 /// | |
| 48:Hs.334629 | | 602203 /// NP_115086 /// NP_037413 | NM_003063 /// | 6832 // small molecule transport // predicted/computed 7155 // cell adhesion // inferred from electronic annotation /// 7165 // signal transduction // traceable author statement |
| 49:Hs.41296 | | 604806 /// NP_938205 | NM_013281 /// | 6355 // regulation of transcription, DNA-dependent // inferred from electronic annotation /// 9653 // morphogenesis // traceable author statement |
| 50:Hs.118608 | ENSG00000123364 | 142976 NP_059106 /// NP_002707 | NM_017410 | |
| 51:Hs.431156 | ENSG00000137713 | 603113 /// NP_859050 | NM_002716 /// | see Addendum |
| 52:Hs.6682 | ENSG00000151012 | 607933 NP_055146 | NM_014331 | 6151 // cell growth and/or maintenance // non-traceable author statement |
| 53:Hs.75823 | ENSG00000143443 | 604684 NP_066809 | NM_066818 | 6810 // aa_permeases;transport;8.2e-31 // |
| 54:Hs.22891 | ENSG00000092068 | 604235 /// NP_877392 | NM_012244 /// | extended:Unknown |
| 55:Hs.1569 | ENSG00000106689 | 603759 NP_004780 /// NP_002393 /// NP_803490 | NM_004789 | 6355 // regulation of transcription, DNA-dependent // inferred from electronic annotation |
| 56:Hs.440459 | ENSG00000106484 | 661029 /// NP_303491 | NM_002402 /// | |
| 57:Hs.351316 | ENSG00000169608 | 191155 NP_055035 | NM_014220 | |
| 58:Hs.431156 | ENSG00000137713 | 603113 /// NP_859050 /// NP_002707 | NM_002716 /// | |
| 59:Hs.114948 | ENSG00000006016 | 604237 NP_004741 | NM_004750 | 19735 // antimicrobial humoral response (sensu Vertebrata) // traceable author statement |
| 60:Hs.352554 | ENSG00000163171 | 606133 NP_066440 | NM_066449 | |
| 61:Hs.391561 | ENSG00000170323 | 600434 NP_001433 | NM_001442 | 6810 // transport // inferred from electronic annotation |
| 62:Hs.69404 | ENSG00000120149 | 123101 NP_002440 | NM_002449 | see Addendum |
| 63:Hs.2962 | ENSG00000163993 | 600614 NP_055971 | NM_055980 | |
| 64:Hs.1501 | ENSG00000169439 | 142460 NP_002989 | NM_002998 | |
| 65:Hs.511745 | ENSG00000176788 | 605940 NP_006308 | NM_006317 | 6355 // regulation of transcription, DNA-dependent // inferred from electronic annotation |
| 66:Hs.288741 | | | | |
| 67:Hs.352554 | ENSG00000163171 | 606133 NP_066440 | NM_066449 | |
| 68:Hs.13350 | ENSG00000107731 | 607870 NP_734465 | NM_170744 | |
| 69:Hs.211201 | ENSG00000055163 | 606323 /// NP_110405 | NM_014376 /// | |
| 70:Hs.194431 | ENSG00000129116 | 608092 NP_057165 | NM_016081 | |
| 71:Hs.424414 | ENSG00000163132 | 142983 NP_002439 | NM_002448 | see Addendum |
| 72:Hs.73853 | ENSG00000125845 | 112261 NP_001191 | NM_001200 | see Addendum |
| 73:Hs.22891 | ENSG00000092068 | 604235 /// NP_877392 | NM_012244 /// | 6810 // aa_permeases;transport;8.2e-31 // extended:Unknown |

Figure 3D.2

| | | | | | |
|---|---|---|---|---|---|
| 74 | Hs.87417 | ENSG00000136943 | 603308 | NP_001324 | NM_001333 | 6508 // proteolysis and peptidolysis // inferred from electronic annotation |
| 75 | Hs.22049 | | | | | |
| 76 | Hs.2288 | ENSG00000163032 | 600817 | NP_003376 | NM_003385 | |
| 77 | Hs.113657 | ENSG00000176463 | | NP_037404 | NM_013272 | 6811 // ion transport // inferred from electronic annotation |
| 78 | Hs.267819 | ENSG00000184203 | 601792 | NP_006232 | NM_006241 | 5977 // glycogen metabolism // inferred from electronic annotation /// 6091 // energy pathways // traceable author statement |
| 79 | Hs.211556 | ENSG00000170522 | | NP_076995 | NM_024090 | |
| 80 | Hs.9975 | ENSG00000164543 | 604726 | NP_004751 /// NP_004383 | NM_004760 | see Addendum |
| 81 | Hs.63931 | ENSG00000165659 | 603803 /// NP_542938 | NP_542937 | NM_004392 /// | 8151 // cell growth and/or maintenance // inferred from electronic annotation |
| 82 | Hs.2288 | ENSG00000163032 | 600817 | NP_003376 | NM_003385 | see Addendum |
| 83 | Hs.93029 | ENSG00000152377 | 602264 | NP_004589 | NM_004596 | |
| 84 | Hs.227777 | ENSG00000112245 | 601585 | NP_003454 | NM_003463 | 6470 // protein amino acid dephosphorylation // not recorded |
| 85 | Hs.512712 | ENSG00000137267 | 191130 | NP_001060 | NM_001069 | |
| 86 | Hs.154654 | ENSG00000138061 | 601771 | NP_000095 | NM_000104 | see Addendum |
| 87 | Hs.119000 | ENSG00000072110 | 102575 | NP_001093 | NM_001102 | |
| 88 | Hs.105689 | ENSG00000119681 | 602091 | NP_000419 | NM_000428 | see Addendum |
| 89 | Hs.79334 | ENSG00000165030 | 605327 | NP_005375 | NM_005384 | |
| 90 | Hs.271809 | ENSG00000143147 | | NP_722561 /// NP_011395 | NM_007369 /// | |
| 91 | Hs.407909 | ENSG00000100097 ENSG00000074729 | 150570 | NP_002296 | NM_022305 | 6915 // apoptosis // traceable author statement /// 7157 // heterophilic cell adhesion // inferred from electronic annotation 7148 // cell shape and cell size control // not recorded /// 7398 // ectoderm development // experimental evidence |
| 92 | Hs.432677 | ENSG00000185479 | 148042 | NP_005546 | NM_005555 | 7242 // intracellular signaling cascade // inferred from electronic annotation |
| 93 | Hs.151176 | ENSG00000156299 | 600687 | NP_003244 | NM_003253 | |
| 94 | Hs.194431 | ENSG00000129116 | 608092 | NP_057165 | NM_016081 | 6508 // proteolysis and peptidolysis // non-traceable author statement |
| 95 | Hs.182579 | ENSG00000002549 | 170250 | NP_056991 | NM_015907 | 6811 // ion transport // inferred from electronic annotation |
| 96 | Hs.410748 | ENSG00000137726 | 606683 | NP_071286 | NM_022003 | 6118 // electron transport // inferred from electronic annotation /// 7165 // signal transduction // not recorded |
| 97 | Hs.434367 | ENSG00000136013 | 601112 /* see below | | NM_003330 /// | see Addendum |
| 97 | NP_003321 /// NP_877393 /// NP_877419 /// NP_877420 | | | | | |
| 98 | Hs.282326 | ENSG00000159200 | 602917 | NP_004405 | NM_004414 | |
| 99 | Hs.82109 | ENSG00000115884 | 186355 | NP_002988 | NM_002997 | |
| 100 | Hs.375108 | ENSG00000185275 | 600074 | NP_037362 | NM_013230 | 6959 // humoral immune response // traceable author statement |
| 101 | Hs.25035 | ENSG00000169504 | 606536 | NP_039234 | NM_013943 | 6811 // ion transport // inferred from electronic annotation /// 6821 // chloride transport // inferred from electronic annotation 6936 // muscle contraction // inferred from electronic annotation /// 7517 // muscle development // inferred from electronic annotation |
| 102 | Hs.443811 | ENSG00000122786 | 114213 /* see below | | NM_004342 /// | |
| 102 | NP_004333 /// NP_149129 /// NP_149130 /// NP_149131 /// NP_149347 | | | | | |
| 103 | Hs.408767 | ENSG00000109846 | 123590 | NP_001876 | NM_001885 | 6457 // protein folding // not recorded /// 6936 // muscle contraction // traceable author statement /// 7601 // vision // not recorded |

Figure 3D.3

| | | | | |
|---|---|---|---|---|
| 104 | Hs.7835 | ENSG00000011028 | | NP_006030 | NM_006039 | 6810 // transport // inferred from electronic annotation |
| 105 | Hs.194431 | ENSG00000129116 | 608092 | NP_057165 | NM_016081 | |
| 106 | Hs.119000 | ENSG00000072110 | 102575 | NP_001093 | NM_001102 | |
| 107 | Hs.433702 | ENSG00000100664 | 601710 /// NP_892116 | NP_001960 /// NP_892116 | NM_001969 | 6446 // regulation of translational initiation // traceable author statement. 8544 // epidermal differentiation // traceable author statement |
| 108 | Hs.2785 | ENSG00000186831 | 148069 | NP_000413 | NM_000422 | see Addendum |
| 109 | Hs.57652 | ENSG00000143126 | 603265 | NP_001399 | NM_001408 | |
| 110 | Hs.75061 | ENSG00000175130 | 602940 | NP_075385 | NM_023009 | 7165 // signal transduction // predicted/computed /// 7399 // neurogenesis // predicted/computed |
| 111 | | | | | | |
| 112 | Hs.3343 | ENSG00000092621 | | NP_006614 | NM_006623 | 6564 // L-serine biosynthesis // not recorded /// 7420 // brain development // traceable author statement |
| 113 | Hs.2316 | ENSG00000125398 | 606160 | NP_000337 | NM_000346 | 1502 // cartilage condensation // not recorded /// 6357 // regulation of transcription from Pol II promoter // traceable author statement |
| 114 | Hs.13350 | ENSG00000107731 | 607870 | NP_734465 | NM_170744 | |
| 115 | Hs.128312 | ENSG00000131626 | | NP_003617 /// NP_803172 | NM_003626 | see Addendum |
| 116 | Hs.76067 | ENSG00000106211 | 602195 | NP_001531 | NM_001540 | 6446 // regulation of translational initiation // traceable author statement |
| 117 | Hs.409202 | ENSG00000101384 | 601920 | NP_000205 | NM_000214 | 7154 // DSL:cell communication;6.2e-41 // extended:inferred from electronic annotation. 6511 // ubiquitin-dependent protein catabolism // traceable author statement /// 6512 // ubiquitin cycle // inferred from electronic annotation |
| 118 | Hs.129663 | ENSG00000072401 | 602961 | NP_003329 | NM_003338 | see Addendum |
| 119 | Hs.80776 | ENSG00000197091 | 602142 | NP_006216 | NM_006225 | |
| 120 | Hs.16622 | ENSG00000147394 | 300381 | NP_009081 | NM_007150 | |
| 121 | Hs.91448 | ENSG00000161326 | 606618 | NP_008957 | NM_007026 | 6470 // protein amino acid dephosphorylation // inferred from electronic annotation |
| 122 | Hs.2062 | ENSG00000111424 | 601769 | NP_000367 | NM_000376 | see Addendum |
| 123 | Hs.435671 | ENSG00000047056 | | NP_054742 | NM_014023 | |
| 124 | Hs.74405 | ENSG00000134308 | | NP_006817 | NM_006826 | 74 // regulation of cell cycle // not recorded /// 6687 // exocytosis // not recorded |
| 125 | Hs.351601 | ENSG00000183175 | | NP_116076 | NM_032687 | |
| 126 | Hs.278526 | ENSG00000148429 | 605405 | * see below | NM_001450 | |
| 127 | Hs.8302 | ENSG00000115641 /// NP_001441 /// NP_963849 /// NP_963850 /// NP_963851 | 602633 | | | |
| 128 | Hs.133892 | ENSG00000140416 | 191010 | NP_000357 | NM_000366 | 6937 // regulation of muscle contraction // predicted/computed /// 8016 // regulation of heart rate // predicted/computed |
| 129 | Hs.83530 | ENSG00000133132 | | NP_061860 | NM_019007 | |
| 130 | Hs.79748 | ENSG00000168003 | 158070 | NP_002385 | NM_002394 | see Addendum |
| 131 | Hs.249600 | ENSG00000080845 | | NP_055717 /// NP_892118 | NM_014902 | 7267 // cell-cell signaling // inferred from electronic annotation |
| 132 | Hs.75090 | ENSG00000190505 | 606555 | NP_055978 /// NP_443210 | NM_015163 | |
| 133 | Hs.77311 | ENSG00000154640 | 605674 | NP_006797 | NM_006806 | 74 // regulation of cell cycle // traceable author statement /// 8285 // negative regulation of cell proliferation // traceable author statement. 7157 // heterophilic cell adhesion // inferred from electronic annotation |
| 134 | Hs.411701 | | 153619 | NP_002297 | NM_002306 | |
| 135 | Hs.408061 | ENSG00000164687 | 605168 | NP_001435 | NM_001444 | see Addendum |
| 136 | Hs.155584 | ENSG00000166899 | | | | |

| | | | | |
|---|---|---|---|---|
| 164 | Hs.183109 | ENSG00000069535 | 309850 NP_000231 | NM_000240 | 6118 // electron transport // inferred from electronic annotation /// 6584 // catecholamine metabolism // inferred from electronic annotation /// 7610 // behavior // traceable author statement /// 42135 // neurotransmitter catabolism // inferred from electronic annotation |
| | | ENSG00000075624 | | | 6928 // cell motility // traceable author statement |
| 165 | Hs.426930 | ENSG00000184009 | 102630 NP_001092 | NM_001101 | 7067 // mitosis // traceable author statement /// 8283 // cell proliferation // traceable author statement |
| 166 | Hs.69360 | ENSG00000142945 | 604538 NP_006836 | NM_006845 | |
| 167 | Hs.404914 | ENSG00000151594 | NP_003174 603639 /// NP_068604 | NM_003183 | 6508 // proteolysis and peptidolysis // inferred from electronic annotation /// 7267 // cell-cell signaling // traceable author statement /// 6928 // cell motility // traceable author statement /// 16042 // lipid catabolism // inferred from electronic annotation |
| 168 | Hs.93354 | ENSG00000168092 | 602508 NP_022563 | NM_022572 | |
| 169 | Hs.2057 | ENSG00000144491 | 258900 NP_000364 | NM_000373 | 6207 // 'de novo' pyrimidine base biosynthesis // inferred from electronic annotation /// 6221 // pyrimidine nucleotide biosynthesis // inferred from electronic annotation /// 6222 // UMP biosynthesis // traceable author statement /// 9116 // nucleoside metabolism // inferred from electronic annotation |
| 170 | Hs.3426 | ENSG00000132591 | NP_005693 | NM_005702 | |
| 171 | Hs.424552 | ENSG00000048162 | NP_057475 | NM_016391 | |
| 172 | Hs.154023 | ENSG00000183527 | 605296 NP_003711 | NM_003720 | 6118 // electron transport // inferred from electronic annotation /// 6457 // protein folding // inferred from direct assay /// 6986 // response to unfolded protein // inferred from direct assay /// 9100 // glycoprotein metabolism // inferred from direct assay /// 30503 // regulation of cell redox homeostasis // traceable author statement /// 45045 // secretory pathway // traceable author statement |
| 173 | Hs.5198 | | NP_005701 | | |
| 174 | Hs.30570 | ENSG00000102103 | NP_652765 300463 /// NP_652766 NP_054837 | NM_005710 | 6355 // regulation of transcription, DNA-dependent // experimental evidence |
| 175 | Hs.159460 | ENSG00000121964 | /// NP_078935 NP_002819 | NM_014118 | |
| 176 | Hs.446126 | ENSG00000175354 | NP_536347 176887 /// NP_536348 | NM_002828 | 8470 // protein amino acid dephosphorylation // predicted/computed |
| 177 | Hs.197335 | ENSG00000104324 | NP_060093 /// NP_057218 | NM_006102 | 6508 // proteolysis and peptidolysis // predicted/computed /// 6518 // peptide metabolism // predicted/computed /// 6508 // proteolysis and peptidolysis // predicted/computed /// 6518 // peptide metabolism // predicted/computed |
| 178 | Hs.263876 | ENSG00000088726 | NP_060776 | NM_018306 | |
| 179 | Hs.416649 | ENSG00000107020 | NP_060935 | NM_018465 | |
| 180 | Hs.7797 | ENSG00000092330 | 604319 NP_036593 | NM_012461 | 7004 // telomerase-dependent telomere maintenance // inferred from electronic annotation |
| 181 | Hs.3708860 | ENSG00000100425 | 604589 NP_055392 | NM_014577 | |

Figure 3D.6

| | | | | | |
|---|---|---|---|---|---|
| 182 | Hs.147259 | ENSG00000165029 | | 600046 | NP_005493 | NM_005502 | 6832 // small molecule transport // not recorded /// 6911 // phagocytosis, engulfment // not recorded /// 8203 // cholesterol metabolism // predicted/computed |
| 183 | Hs.76768 | ENSG00000122884 | | 176710 | NP_000908 | NM_000917 | 19538 // protein metabolism // inferred from electronic annotation |
| 184 | Hs.284208 | ENSG00000130157 | | | NP_056308 /// NP_060086 | NM_015493 /// | |
| 185 | Hs.79197 | ENSG00000112149 | | 604534 | NP_004224 | NM_004233 | 6952 // defense response // traceable author statement /// 6959 // humoral immune response // traceable author statement /// 7165 // signal transduction // traceable author statement |
| 186 | Hs.5243 | ENSG00000114023 | | 608017 | NP_055182 | NM_014367 | |
| 187 | Hs.417332 | * see below | | 142720 | NP_003507 | NM_003516 | 6334 // nucleosome assembly // non-traceable author statement /// 7001 // chromosome organization and biogenesis (sensu Eukarya) // non-traceable author statement |
| 187 | ENSG00000124518 /// ENSG00000137173 /// ENSG00000180573 /// ENSG00000183558 / ENSG00000183717 | | | | | | |
| 187 | ENSG00000183868 /// ENSG00000183932 /// ENSG00000184346 | | | | | | |
| 188 | Hs.151134 | ENSG00000154463 | | 601086 | NP_005096 /// NP_116580 | NM_005015 | 6118 // electron transport // traceable author statement /// 6461 // protein complex assembly // traceable author statement /// 7165 // signal transduction // inferred from electronic annotation /// 9060 // aerobic respiration // traceable author statement |
| 189 | Hs.406505 | ENSG00000170667 | | | NP_116581 /// NP_663165 | NM_032958 | 6350 // transcription // inferred from electronic annotation |
| 190 | Hs.11866 | ENSG00000138297 | | 605034 | NP_006318 | NM_006327 | 6605 // protein targeting // inferred from electronic annotation /// 6628 // mitochondrial translocation // traceable author statement /// 74 // regulation of cell cycle // traceable author statement /// 6468 // protein amino acid phosphorylation // inferred from electronic annotation /// 7165 // signal transduction // traceable author statement /// 8151 // cell growth and/or maintenance // inferred from electronic annotation |
| 191 | Hs.83341 | ENSG00000167601 | | 109135 | NP_001690 /// NP_068713 | NM_001699 | |
| 192 | Hs.154224 | ENSG00000134391 | | 600889 | NP_055657 | NM_005666 | |
| 193 | Hs.433429 | ENSG00000180957 | | 600174 | NP_006215 | NM_006224 | 6629 // lipid metabolism // not recorded /// 6810 // transport // inferred from electronic annotation /// 7601 // vision // traceable author statement |
| 194 | Hs.82030 | ENSG00000140105 | | 191050 | NP_004175 | NM_004184 | 6436 // tryptophanyl-tRNA aminoacylation // traceable author statement /// 8285 // negative regulation of cell proliferation // traceable author statement |
| 195 | Hs.77348 | ENSG00000164120 | | 601688 | NP_000851 | NM_000860 | 6693 // prostaglandin metabolism // inferred from electronic annotation /// 8152 // metabolism // inferred from electronic annotation |
| 196 | Hs.310230 | ENSG00000065308 | | 109700 | NP_004039 | NM_004048 | 6605 // protein targeting // inferred from electronic annotation |
| 197 | Hs.48516 | ENSG00000166710 | | | | | |

Figure 3D.7

| | | | | |
|---|---|---|---|---|
| 198 | Hs.512152 | ENSG00000168745 | 142871 / NP_002118 | NM_002127 | 6968 // cellular defense response // traceable author statement /// 9596 // perception of pest/pathogen/parasite // traceable author statement /// 19883 // antigen presentation, endogenous antigen // inferred from electronic annotation /// 19885 // antigen processing, endogenous antigen via MHC class I // inferred from electronic annotation /// 6955 // MHC_I;immune response;1.4e-142 // extended:inferred from electronic annotation |
| 199 | Hs.107526 | ENSG00000158470 | 604016 / NP_004767 | NM_004776 | 5975 // carbohydrate metabolism // inferred from electronic annotation. |
| 200 | Hs.437425 | ENSG00000101577 | 605519 / NP_054461 / NP_004381 | NM_014646 | |
| 201 | Hs.114931 | ENSG00000103811 | 116820 / NP_683880 | NM_004390 | 6508 // proteolysis and peptidolysis // traceable author statement |
| 202 | Hs.23729 | | | | |
| 203 | Hs.300772 | ENSG00000166856 | 190990 / NP_003280 | NM_003289 | 7517 // muscle development // inferred from electronic annotation. 7165 // signal transduction // not recorded /// 6955 // MHC_II_beta;immune response;6.4e-56 // extended:inferred from electronic annotation |
| 204 | Hs.308026 | ENSG00000180328 | NP_072049 | NM_022555 | 7275 // development // traceable author statement /// 7399 // neurogenesis // not recorded // 8283 // cell proliferation // traceable author statement /// 16525 // negative regulation of angiogenesis // traceable author statement |
| 205 | Hs.173594 | ENSG00000132386 | 172860 / NP_002606 | NM_002615 | 6468 // protein amino acid phosphorylation // inferred from electronic annotation /// 7165 // signal transduction // traceable author statement /// 7169 // transmembrane receptor protein tyrosine kinase signaling pathway // inferred from electronic annotation /// 8151 // cell growth and/or maintenance // inferred from electronic annotation |
| 206 | Hs.307783 | ENSG00000113721 | 173410 / NP_002600 | NM_002609 | |
| 207 | Hs.137556 | ENSG00000148600 | NP_149091 / NP_055737 /// NP_877591 /// | NM_033100 / NM_005746 /// | |
| 208 | Hs.293464 | ENSG00000105835 | | | 6730 // one-carbon compound metabolism // inferred from electronic annotation. |
| 209 | Hs.279916 | ENSG00000074410 | 603263 / NP_011209 | NM_011218 | 6629 // lipid metabolism // traceable author statement /// 6869 // lipid transport // inferred from electronic annotation. |
| 210 | Hs.439312 | ENSG00000109979 | NP_006218 / NP_872617 | NM_006227 | |
| 211 | Hs.57079 | | | | |
| 212 | Hs.274485 | ENSG00000137225 | 142840 / NP_002108 | NM_002117 | 6955 // immune response // non-traceable author statement. 6468 // protein amino acid phosphorylation // experimental evidence /// 6607 // NLS-bearing substrate-nucleus import // predicted/computed /// 6955 // immune response // predicted/computed /// 7165 // signal transduction // experimental evidence /// 7243 // protein kinase cascade // experimental |
| 213 | Hs.276506 | ENSG00000082074 | 602731 /// NP_955367 | NM_001465 | evidence. |
| 214 | Hs.232021 | ENSG00000009413 | 602776 / NP_002903 | NM_002912 | 6261 // DNA dependent DNA replication // experimental evidence |

Figure 3D.8

| | | | | |
|---|---|---|---|---|
| 215 | Hs.512152 | ENSG00000168745 | 142871 | NP_002118 | NM_002127 | 6968 // cellular defense response // traceable author statement /// 9596 // perception of pest/pathogen/parasite // traceable author statement /// 19883 // antigen presentation, endogenous antigen // inferred from electronic annotation /// 19885 // antigen processing, endogenous antigen via MHC class I // inferred from electronic annotation /// 6955 // MHC_I;immune response,1.4e-142 // extended:inferred from electronic annotation |
| 216 | Hs.409805 | ENSG00000168423 | 142860 | NP_061964 | NM_019111 | 6955 // immune response // non-traceable author statement /// 19884 // antigen presentation, exogenous antigen // inferred from electronic annotation /// 19886 // antigen processing, exogenous antigen via MHC class II // inferred from electronic annotation |
| 217 | Hs.80296 | ENSG00000183036 | 6016629 | NP_006189 | NM_006198 | 7417 // central nervous system development // traceable author statement |
| 218 | Hs.16530 | ENSG00000060074 | 6037757 | NP_002979 | NM_002988 | 6935 // chemotaxis // traceable author statement /// 6954 // inflammatory response // inferred from electronic annotation /// 6955 // immune response // traceable author statement /// 7165 // signal transduction // traceable author statement /// 7267 // cell-cell signaling // traceable author statement /// 9607 // response to biotic stimulus // traceable author statement /// 19735 // antimicrobial humoral response (sensu Vertebrata) // traceable author statement |
| 219 | Hs.377894 | ENSG00000115271 | 6070330 | NP_036330 | NM_012198 | 6944 // membrane fusion // traceable author statement |
| 220 | Hs.274485 | ENSG00000137325 | 142840 | NP_002108 | NM_002117 | 6955 // immune response // non-traceable author statement |
| 221 | Hs.512778 | ENSG00000114473 | NP_079387 /// NP_115639 | NM_025111 | --- |
| 222 | Hs.446641 | ENSG00000102265 | 305370 | NP_003245 /// NP_0554437 | NM_003254 | 6508 // proteolysis and peptidolysis // non-traceable author statement /// 7275 // development // not recorded /// 8284 // positive regulation of cell proliferation // traceable author statement |
| 223 | Hs.152944 | ENSG00000110002 | 602929 | NP_938057 | NM_014622 | --- |
| 224 | Hs.368409 | ENSG00000168383 | 142858 | NP_002112 /// NP_061902 /// NP_112601 | NM_002121 | 9405 // pathogenesis // experimental evidence /// 9596 // perception of pest/pathogen/parasite // experimental evidence,3.1e-49 // extended:inferred from electronic annotation |
| 225 | Hs.95594 | ENSG00000106066 | --- | NP_002017 | NM_019029 | 6508 // proteolysis and peptidolysis // inferred from electronic annotation |
| 226 | Hs.418138 | ENSG00000115414 | 135600 | NP_473375 | NM_002026 | 6928 // cell motility // not recorded /// 7155 // cell adhesion // not recorded /// 7165 // signal transduction // not recorded |
| 227 | Hs.773348 | ENSG00000164120 | 601688 | NP_000851 | NM_000860 | 6693 // prostaglandin metabolism // inferred from electronic annotation /// 8152 // metabolism // inferred from electronic annotation |
| 228 | NP_001911 /// NP_598010 /// NP_598011 /// NP_598012 /// NP_598013 /// NP_598014 | ENSG00000011465 | 1252551 | * see below | NM_001920 | 9887 // organogenesis // traceable author statement |

Figure 3D.9

| | | | | |
|---|---|---|---|---|
| 229 | Hs.525620 | ENSG00000162407 | | NP_003704 | 6629 // lipid metabolism // not recorded /// 8151 // cell growth and/or maintenance // traceable author statement /// 8354 // germ- |
| 230 | Hs.15871 | ENSG00000162836 | 607125 /// NP_803133 | NM_003713 | cell migration // traceable author statement |
| | | | NP_057445 | NM_016361 | |
| 231 | Hs.914 | ENSG00000168384 | 142880 NP_291032 | NM_033554 | 6955 // immune response // non-traceable author statement, /// 19884 // antigen presentation, exogenous antigen // inferred from electronic annotation /// 19886 // antigen processing, exogenous antigen via MHC class II // inferred from electronic annotation |
| 232 | Hs.80645 | ENSG00000125347 | 147575 NP_002189 | NM_002198 | 6355 // regulation of transcription, DNA-dependent // inferred from electronic annotation /// 6366 // transcription from Pol II promoter // traceable author statement /// 6955 // immune response // inferred from electronic annotation /// 45786 // negative regulation of cell cycle // inferred from electronic annotation |
| 233 | Hs.6909 | ENSG00000079931 | NP_056344 | NM_015229 | 6584 // catecholamine metabolism // inferred from electronic annotation |
| 234 | Hs.444324 | ENSG00000081237 | 151460 | NM_002836 | 6470 // protein amino acid dephosphorylation // inferred from electronic annotation /// 7166 // cell surface receptor linked signal transduction // traceable author statement |
| 234 | NP_002829 /// NP_563578 /// NP_563579 /// NP_563580 | | | | |
| 235 | Hs.318501 | ENSG00000132274 | 606559 NP_006065 | NM_006074 | |
| 236 | Hs.234734 | ENSG00000090382 | 153450 NP_000230 | NM_000239 | 5975 // carbohydrate metabolism // inferred from electronic annotation /// 6954 // inflammatory response // traceable author statement /// 16998 // cell wall catabolism // inferred from electronic annotation /// 19835 // cytolysis // not recorded |
| 237 | Hs.367877 | ENSG00000087245 | 120360 NP_004521 | NM_004530 | 30574 // collagen catabolism // inferred from electronic annotation |
| 238 | Hs.103505 | ENSG00000126233 | 606119 NP_065160 | NM_020427 | |
| 239 | Hs.76392 | ENSG00000165092 | 100640 NP_000680 | NM_000689 | 6081 // aldehyde metabolism // traceable author statement |
| 240 | Hs.75678 | ENSG00000125740 | 164772 NP_066723 | NM_066732 | 74 // regulation of cell cycle // not recorded /// 122 // negative regulation of transcription from Pol II promoter // traceable author statement /// 6355 // regulation of transcription, DNA-dependent // inferred from electronic annotation /// 7275 // development // traceable author statement |
| 241 | Hs.301865 | ENSG00000080166 | 191275 NP_019913 | NM_019922 | 6583 // melanin biosynthesis from tyrosine // traceable author statement /// 8152 // metabolism // inferred from electronic annotation /// 8544 // epidermal differentiation // traceable author statement |
| 242 | Hs.446429 | ENSG00000107317 | 176803 NP_000945 | NM_000954 | 1516 // prostaglandin biosynthesis // inferred from sequence or structural similarity /// 6810 // transport // inferred from sequence or structural similarity /// 45187 // regulation of circadian sleep/wake cycle, sleep // inferred from sequence or structural similarity |
| 243 | | | | | |

Figure 3D.10

| | | | | |
|---|---|---|---|---|
| 244 | Hs.155376 | ENSG00000161280 | 141900 NP_000509 | NM_000518 | 15671 // globin;oxygen transport;3.1e-64 // extended;non-traceable author statement |
| 245 | Hs.449630 | ENSG00000130654 | 141850 NP_000508 | NM_000517 | 15671 // globin;oxygen transport;1.3e-58 // extended;non-traceable author statement |
| 246 | Hs.449630 | ENSG00000130654 | 141850 NP_000508 | NM_000517 | 15671 // globin;oxygen transport;1.3e-58 // extended;non-traceable author statement |
| 247 | Hs.449630 | ENSG00000130654 | 141850 NP_000508 | NM_000517 | 15671 // globin;oxygen transport;1.3e-58 // extended;non-traceable author statement |
| 248 | Hs.449630 | | 141850 NP_000508 | | 15671 // globin;oxygen transport;1.3e-58 // extended;non-traceable author statement |
| 249 | --- | --- | --- | --- | --- |
| 250 | Hs.449630 | ENSG00000130654 | 141850 NP_000508 | NM_000517 | 15671 // globin;oxygen transport;1.3e-58 // extended;non-traceable author statement |
| 251 | Hs.155376 | ENSG00000161280 | 141900 NP_000509 | NM_000518 | 15671 // globin;oxygen transport;3.1e-64 // extended;non-traceable author statement |

Figure 3D.11

| SEQ ID No | Gene Ontology Biological Process_Affymetrix |
|---|---|
| 23 | 6355 // regulation of transcription, DNA-dependent // inferred from electronic annotation /// 7165 // signal transduction // traceable author statement /// 7267 // cell-cell signaling // traceable author statement /// 8284 // positive regulation of cell proliferation // traceable author statement /// 9653 // morphogenesis // traceable author statement |
| 24 | 6355 // regulation of transcription, DNA-dependent // inferred from electronic annotation /// 7165 // signal transduction // traceable author statement /// 7267 // cell-cell signaling // traceable author statement /// 8284 // positive regulation of cell proliferation // traceable author statement /// 9653 // morphogenesis // traceable author statement |
| 41 | 1501 // skeletal development // traceable author statement /// 7267 // cell-cell signaling // traceable author statement /// 8151 // cell growth and/or maintenance // inferred from electronic annotation /// 40007 // growth // inferred from electronic annotation |
| 44 | 1502 // cartilage condensation // traceable author statement /// 7601 // vision // traceable author statement /// 7605 // hearing // inferred from electronic annotation /// 16337 // cell-cell adhesion // non-traceable author statement /// 30198 // extracellular matrix organization and biogenesis // non-traceable author statement |
| 46 | 6928 // cell motility // not recorded /// 7155 // cell adhesion // inferred from electronic annotation /// 7275 // development // traceable author statement /// 7399 // neurogenesis // not recorded /// 7596 // blood coagulation // not recorded |
| 52 | 6461 // protein complex assembly // not recorded /// 6810 // transport // inferred from electronic annotation /// 6865 // amino acid transport // inferred from electronic annotation |
| 62 | 1501 // skeletal development // traceable author statement /// 6355 // regulation of transcription, DNA-dependent // inferred from electronic annotation /// 7275 // development // inferred from electronic annotation |
| 71 | 1501 // skeletal development // traceable author statement /// 6355 // regulation of transcription, DNA-dependent // inferred from electronic annotation /// 7275 // development // inferred from electronic annotation |
| 72 | 1501 // skeletal development // traceable author statement /// 7267 // cell-cell signaling // traceable author statement /// 8151 // cell growth and/or maintenance // inferred from electronic annotation /// 40007 // growth // inferred from electronic annotation |
| 80 | 6468 // protein amino acid phosphorylation // traceable author statement /// 6915 // apoptosis // inferred from electronic annotation /// 6917 // induction of apoptosis // traceable author statement |
| 83 | 6928 // cell motility // traceable author statement /// 7155 // cell adhesion // traceable author statement /// 7275 // development // traceable author statement /// 7399 // neurogenesis // traceable author statement /// 8283 // cell proliferation // traceable author statement |
| 86 | 1747 // eye morphogenesis (sensu Mammalia) // traceable author statement /// 6118 // electron transport // inferred from electronic annotation /// 7601 // vision // traceable author statement |

Figure 3D.12

| | |
|---|---|
| 88 | 74 // regulation of cell cycle // not recorded /// 6605 // protein targeting // traceable author statement /// 6858 // extracellular transport // not recorded /// 7179 // transforming growth factor beta receptor signaling pathway // traceable author statement /// 9306 // protein secretion // traceable author statement |
| 98 | 7165 // signal transduction // traceable author statement /// 7417 // central nervous system development // traceable author statement /// 8015 // circulation // traceable author statement /// 19722 // calcium-mediated signaling // inferred from electronic annotation |
| 109 | 7156 // homophilic cell adhesion // inferred from electronic annotation /// 7218 // neuropeptide signaling pathway // inferred from electronic annotation /// 7275 // development // inferred from electronic annotation |
| 115 | 7148 // cell shape and cell size control // experimental evidence /// 7160 // cell-matrix adhesion // experimental evidence /// 7165 // signal transduction // predicted/computed |
| 119 | 6644 // phospholipid metabolism // traceable author statement /// 7242 // intracellular signaling cascade // inferred from electronic annotation /// 16042 // lipid catabolism // inferred from electronic annotation |
| 122 | 6355 // regulation of transcription, DNA-dependent // inferred from electronic annotation /// 7165 // signal transduction // traceable author statement |
| 130 | 5975 // carbohydrate metabolism // inferred from electronic annotation /// 6865 // amino acid transport // traceable author statement /// 16049 // cell growth // non-traceable author statement /// 30181 // sodium:calcium exchange // non-traceable author statement |
| 135 | 6629 // lipid metabolism // traceable author statement /// 6810 // transport // inferred from electronic annotation /// 8544 // epidermal differentiation // traceable author statement |
| 149 | 6355 // regulation of transcription, DNA-dependent // non-traceable author statement /// 7165 // signal transduction // inferred from electronic annotation |
| 152 | 6950 // response to stress // traceable author statement /// 9628 // response to abiotic stimulus // traceable author statement /// 6950 // response to stress // traceable author statement /// 9628 // response to abiotic stimulus // traceable author statement |
| 153 | 6768 // biotin metabolism // not recorded /// 6807 // nitrogen metabolism // inferred from electronic annotation /// 7417 // central nervous system development // traceable author statement /// 8544 // epidermal differentiation // traceable author statement |
| 161 | 74 // regulation of cell cycle // traceable author statement /// 1558 // regulation of cell growth // inferred from electronic annotation /// 7067 // mitosis // inferred from electronic annotation /// 7155 // cell adhesion // not recorded /// 7165 // signal transduction // traceable author statement |
| 164 | 6118 // electron transport // inferred from electronic annotation /// 6584 // catecholamine metabolism // inferred from electronic annotation /// 7610 // behavior // traceable author statement /// 42135 // neurotransmitter catabolism // inferred from electronic annotation |
| 169 | 6207 // 'de novo' pyrimidine base biosynthesis // inferred from electronic annotation /// 6221 // pyrimidine nucleotide biosynthesis // inferred from electronic annotation /// 6222 // UMP biosynthesis // traceable author statement /// 9116 // nucleoside metabolism // inferred from electronic annotation |

Figure 3D.13

| 172 | 6118 // electron transport // inferred from electronic annotation /// 6457 // protein folding // inferred from direct assay /// 6986 // response to unfolded protein // inferred from direct assay /// 9100 // glycoprotein metabolism // inferred from direct assay /// 30503 // regulation of cell redox homeostasis // traceable author statement /// 45045 // secretory pathway // traceable author statement |
|---|---|
| 177 | 6508 // proteolysis and peptidolysis // predicted/computed /// 6518 // peptide metabolism // predicted/computed /// 6508 // proteolysis and peptidolysis // predicted/computed /// 6518 // peptide metabolism // predicted/computed |
| 182 | 6832 // small molecule transport // not recorded /// 6911 // phagocytosis, engulfment // not recorded /// 8203 // cholesterol metabolism // predicted/computed |
| 188 | 6118 // electron transport // traceable author statement /// 6461 // protein complex assembly // traceable author statement /// 7165 // signal transduction // inferred from electronic annotation /// 9060 // aerobic respiration // traceable author statement |
| 191 | 74 // regulation of cell cycle // traceable author statement /// 6468 // protein amino acid phosphorylation // inferred from electronic annotation /// 7165 // signal transduction // traceable author statement /// 8151 // cell growth and/or maintenance // inferred from electronic annotation |
| 198 | 6968 // cellular defense response // traceable author statement /// 9596 // perception of pest/pathogen/parasite // traceable author statement /// 19883 // antigen presentation, endogenous antigen // inferred from electronic annotation /// 19885 // antigen processing, endogenous antigen via MHC class I // inferred from electronic annotation /// 6955 // MHC_I;immune response;1.4e-142 // extended:inferred from electronic annotation |
| 205 | 7275 // development // traceable author statement /// 7399 // neurogenesis // not recorded /// 8283 // cell proliferation // traceable author statement /// 16525 // negative regulation of angiogenesis // traceable author statement |
| 206 | 6468 // protein amino acid phosphorylation // inferred from electronic annotation /// 7165 // signal transduction // traceable author statement /// 7169 // transmembrane receptor protein tyrosine kinase signaling pathway // inferred from electronic annotation /// 8151 // cell growth and/or maintenance // inferred from electronic annotation |
| 213 | 6468 // protein amino acid phosphorylation // experimental evidence /// 6607 // NLS-bearing substrate-nucleus import // predicted/computed /// 6955 // immune response // predicted/computed /// 7165 // signal transduction // experimental evidence /// 7243 // protein kinase cascade // experimental evidence |
| 215 | 6968 // cellular defense response // traceable author statement /// 9596 // perception of pest/pathogen/parasite // traceable author statement /// 19883 // antigen presentation, endogenous antigen // inferred from electronic annotation /// 19885 // antigen processing, endogenous antigen via MHC class I // inferred from electronic annotation /// 6955 // MHC_I;immune response;1.4e-142 // extended:inferred from electronic annotation |

Figure 3D.14

| | |
|---|---|
| 218 | 6935 // chemotaxis // traceable author statement /// 6954 // inflammatory response // inferred from electronic annotation /// 6955 // immune response // traceable author statement /// 7165 // signal transduction // traceable author statement /// 7267 // cell-cell signaling // traceable author statement /// 9607 // response to biotic stimulus // traceable author statement /// 19735 // antimicrobial humoral response (sensu Vertebrata) // traceable author statement |
| 224 | 9405 // pathogenesis // experimental evidence /// 9596 // perception of pest/pathogen/parasite // experimental evidence /// 6955 // MHC_II_beta;immune response;3.1e-49 // extended:inferred from electronic annotation |
| 231 | 6955 // immune response // non-traceable author statement /// 19884 // antigen presentation, exogenous antigen // inferred from electronic annotation /// 19886 // antigen processing, exogenous antigen via MHC class II // inferred from electronic annotation |
| 232 | 6355 // regulation of transcription, DNA-dependent // inferred from electronic annotation /// 6366 // transcription from Pol II promoter // traceable author statement /// 6955 // immune response // inferred from electronic annotation /// 45786 // negative regulation of cell cycle // inferred from electronic annotation |
| 236 | 5975 // carbohydrate metabolism // inferred from electronic annotation /// 6954 // inflammatory response // traceable author statement /// 16998 // cell wall catabolism // inferred from electronic annotation /// 19835 // cytolysis // not recorded |
| 240 | 74 // regulation of cell cycle // not recorded /// 122 // negative regulation of transcription from Pol II promoter // traceable author statement /// 6355 // regulation of transcription, DNA-dependent // inferred from electronic annotation /// 7275 // development // traceable author statement /// 7610 // behavior // traceable author statement |
| 241 | 6583 // melanin biosynthesis from tyrosine // traceable author statement /// 8152 // metabolism // inferred from electronic annotation /// 8544 // epidermal differentiation // traceable author statement |
| 242 | 1516 // prostaglandin biosynthesis // inferred from sequence or structural similarity /// 6810 // transport // inferred from sequence or structural similarity /// 45187 // regulation of circadian sleep/wake cycle, sleep // inferred from sequence or structural similarity |

Figure 3D.15

| SEQ ID No. | InterPro_Affymetrix | Trans Membrane_Affy metrix | DBid | GO biological process | GO cellular component | GO molecular function |
|---|---|---|---|---|---|---|
| 1 | | | | | | |
| 2 | IPR001664 // Intermediate filament protein /// IPR002957 // Keratin, type I | | GeneID:3884; LocusID:3884; MIM:602762; GI:10337581 | | intermediate filament | structural molecule activity |
| 3 | | | | | | |
| 4 | IPR001664 // Intermediate filament protein /// IPR002957 // Keratin, type I | | GeneID:3885; LocusID:3885; MIM:602763; GI:14917119 GeneID:3883; LocusID:3883; MIM:602761; GI:14917117 | | intermediate filament | structural molecule activity |
| 5 | | | | | | |
| 6 | IPR002494 // Keratin, high sulfur B2 protein | | GeneID:81851; LocusID:81851; GI:13569942 | biological process unknown | extracellular; keratin filament | structural constituent of epidermis |
| 7 | IPR002494 // Keratin, high sulfur B2 protein | | GeneID:81850; LocusID:81850; GI:13569940 | biological process unknown | extracellular; keratin filament | structural constituent of epidermis |
| 8 | IPR001664 // Intermediate filament protein /// IPR002957 // Keratin, type I | | GeneID:3881; LocusID:3881; MIM:601077; GI:14917115 | epidermis development | intermediate filament | structural constituent of cytoskeleton; structural molecule activity |
| 9 | IPR000337 // G-protein coupled receptor family 3, metabotropic glutamate receptor-like /// IPR002956 // Bride of sevenless protein | NP_061124 // 7 // 0.0327 | GeneID:55507; LocusID:55507; MIM:607437; GI:8923705 | visual perception | membrane | metabotropic glutamate, GABA-B-like receptor activity; sevenless binding |
| 10 | IPR001664 // Intermediate filament protein /// IPR003054 // Type II keratin | | GeneID:3887; LocusID:3887; MIM:602153; GI:4504931 | | | |
| 11 | IPR001664 // Intermediate filament protein /// IPR003054 // Type II keratin | | GI:1903220; GOA:P78387; TrEMBL:P78387 | | | |
| 12 | IPR002181 // Fibrinogen, beta/gamma chain, C-terminal globular | NP_066969 // 1 // 0.94583 | GeneID:10218; LocusID:10218; GI:108663949 | response to oxidative stress | cytoplasm; soluble fraction | |
| 13 | IPR007110 // Immunoglobulin-like /// IPR003599 // Immunoglobulin subtype | NP_067069 // 2 // 0.01411 | GeneID:58530; LocusID:58530; MIM:606036; GI:108864055 | | | |
| 14 | IPR002494 // Keratin, high sulfur B2 protein /// IPR011368 // TNFR/CD27/30/40/95 cysteine-rich region /// IPR001007 // von Willebrand factor, type C | | GI:126554452; TrEMBL:Q9BYR0 GI:1668744; GOA:Q92764; Swiss-Prot:Q92764 | morphogenesis | keratin filament | |
| 15 | IPR001664 // Intermediate filament protein /// IPR002957 // Keratin, type I | | GeneID:3889; LocusID:3889; GI:15431323 | epidermis development | intermediate filament | structural molecule activity |
| 16 | IPR003054 // Type II keratin protein /// IPR002223 // Pancreatic trypsin inhibitor (Kunitz) | | | | intermediate filament | structural molecule activity |
| 17 | IPR001751 // Calcium-binding protein, S-100/ICaBP type /// IPR002048 // Calcium-binding EF-hand /// IPR000345 // Cytochrome c, heme-binding site | | GeneID:6274; LocusID:6274; MIM:176992; GI:4506763 | | | calcium ion binding |

Figure 3E.1

| # | Domain/Description | | Identifiers | Biological Process | Cellular Component | Molecular Function |
|---|---|---|---|---|---|---|
| 18 | IPR006209 // EGF-like domain /// IPR003367 // Thrombospondin type 3 repeat /// IPR008859 // Thrombospondin, C-terminal /// IPR002048 // Calcium-binding EF-hand /// IPR001881 // EGF-like calcium-binding /// IPR000742 // EGF-like domain, subtype 2 /// IPR009030 // Growth factor, receptor | | GeneID:1311; LocusID:1311; MIM:600310; GI:40217843 | cell adhesion; skeletal development | extracellular matrix | calcium ion binding; extracellular matrix structural constituent; protein binding |
| 19 | IPR001664 // Intermediate filament protein /// IPR003054 // Type II keratin | | GeneID:3891; LocusID:3891; MIM:602767; GI:4504935 | epidermis development | intermediate filament | structural molecule activity |
| 20 | IPR001664 // Intermediate filament protein /// IPR002957 // Keratin, type 1 | | GeneID:3882; LocusID:3882; MIM:602760; GI:154331312 | epidermis development | intermediate filament | structural molecule activity |
| 21 | | | GeneID:170680; LocusID:170680; GI:76626665 | biological_process unknown | cellular_component unknown | molecular_function unknown |
| 22 | IPR000276 // Rhodopsin-like GPCR superfamily /// IPR001611 // Leucine-rich repeat /// IPR000372 // Cysteine-rich flanking region, N-terminal /// IPR002131 // Glycoprotein hormone receptor /// IPR003591 // Leucine-rich repeat, typical subtype | NP_003658 // 0.01875 | | | | |
| 23 | IPR002348 // Interleukin 1/heparin-binding growth factor /// IPR008996 // Cytokine, IL-1 related | | GeneID:8817; LocusID:8817; MIM:603726; GI:45036695 | cell-cell signaling; morphogenesis; positive regulation of cell proliferation; signal transduction | extracellular space | growth factor activity |
| 24 | IPR002348 // Interleukin 1/heparin-binding growth factor /// IPR008996 // Cytokine, IL-1 related | | LocusID:8817; MIM:603726; GI:136232789 | cell-cell signaling; morphogenesis; positive regulation of cell proliferation; signal transduction | extracellular space | growth factor activity |
| 25 | IPR001664 // Intermediate filament protein /// IPR002957 // Keratin, type I /// IPR003054 // Type II keratin /// IPR006311 // Twin-arginine translocation pathway signal | | GeneID:9119; LocusID:9119; GI:4758618 | | intermediate filament | structural molecule activity |
| 26 | IPR000215 // Serpin | | GeneID:5265; LocusID:5265; MIM:107400; GI:21361198 | acute-phase response | | protein binding; serine-type endopeptidase inhibitor activity |
| 27 | IPR009828 // Protein of unknown function DUF1394 | | GeneID:81553; LocusID:81553; GI:13540580 | | | |
| 28 | | | | | | |
| 29 | IPR001611 // Leucine-rich repeat /// IPR003591 // Leucine-rich repeat, typical subtype /// IPR000372 // Cysteine-rich flanking region, N-terminal /// IPR000483 // Cysteine-rich flanking region, C-terminal | | GeneID:25849; LocusID:25849; GI:7661632 | | | |
| 30 | | | | | | |

Figure 3E.2

| # | Domain | Accession | Process | Location | Function |
|---|---|---|---|---|---|
| 31 | IPR000873 // AMP-dependent synthetase and ligase /// IPR000357 // HEAT /// IPR008938 // ARM repeat fold | | GeneID:28965; LocusID:28965; MIM:604196; GI:133225055 | metabolism; very-long-chain fatty acid metabolism | | catalytic activity; long-chain-fatty-acid-CoA ligase activity |
| 32 | | | | | |
| 33 | IPR002048 // Calcium-binding EF-hand /// IPR000261 // EPS15 homology (EH) /// IPR001606 // ARID (AT-rich interaction domain) protein | | GeneID:30845; LocusID:30845; MIM:605891; GI:7657056 | | nucleus | ATP binding; calcium ion binding; nucleic acid binding |
| 34 | IPR009345 // BMP and activin membrane-bound inhibitor | | GeneID:25805; LocusID:25805; MIM:604444; GI:6912534 | | integral to membrane | |
| 35 | IPR001664 // Intermediate filament protein /// IPR002957 // Keratin, type I | | GI:4091879 | | | |
| 36 | IPR002048 // Calcium-binding EF-hand | | LocusID:80303; GI:12803269 | | | calcium ion binding |
| 37 | IPR007087 // Zn-finger, C2H2 type /// IPR000345 // Cytochrome c heme-binding site | | | | | |
| 38 | IPR001478 // PDZ/DHR/GLGF domain /// IPR001841 // Zn-finger, RING /// IPR000345 // Cytochrome c heme-binding site /// IPR001293 // Zn-finger, TRAF type /// IPR008974 // TRAF domain-like | NP_004258 // 1 // 0.94183 | | | | |
| 39 | IPR000910 // HMG1/2 (high mobility group) box /// IPR009071 // High mobility group box | | GI:9858158 | Wnt receptor signaling pathway; regulation of transcription, DNA-dependent | nucleus | DNA binding |
| 40 | IPR000863 // Sulfotransferase | | GeneID:9435; LocusID:9435; MIM:603798; GI:27369497 | | | sulfotransferase activity |
| 41 | IPR001839 // Transforming growth factor beta /// IPR001111 // Transforming growth factor beta (TGFb), N-terminal /// IPR002405 // Inhibin, alpha subunit | | GeneID:650; LocusID:650; MIM:112261; GI:4557369 | cell growth and/or maintenance; cell-cell signaling; skeletal development | extracellular | cytokine activity; growth factor activity |
| 42 | IPR000215 // Serpin | | GeneID:12; LocusID:12; MIM:107280; GI:4501843 | | | |
| 43 | IPR000276 // Rhodopsin-like GPCR superfamily /// IPR001611 // Leucine-rich repeat /// IPR000372 // Cysteine-rich flanking region, N-terminal /// IPR002131 // Glycoprotein hormone receptor /// IPR003591 // Leucine-rich repeat, typical subtype | NP_003658 // 7 // 0.01875 | GI:3366802 | G-protein coupled receptor protein signaling pathway | integral to plasma membrane | protein-hormone receptor activity |
| 44 | IPR008161 // Collagen helix repeat /// IPR000885 // Fibrillar collagen, C-terminal /// IPR008160 // Collagen triple helix repeat /// IPR003129 // Thrombospondin, N-terminal /// IPR001791 // Laminin G /// IPR008985 // Concanavalin A-like lectin/glucanase | | GI:179730; GDB:G00-120-595 | cartilage condensation; cell-cell adhesion; extracellular matrix organization and biogenesis; perception of sound; visual perception | collagen; collagen type XI | extracellular matrix structural constituent; protein binding, bridging |

Figure 3E.3

| | | | | |
|---|---|---|---|---|
| 45 | IPR001356 // Homeobox /// IPR001781 // Zn-binding protein, LIM /// IPR007107 // LIM homeobox /// IPR009057 // Homeodomain-like | | GeneID:9355; LocusID:9355; MIM:603759; GI:307951196 | regulation of transcription, DNA-dependent | nucleus | transcription factor activity; zinc ion binding |
| 46 | IPR006209 // EGF-like domain /// IPR000884 // Thrombospondin, type 1 /// IPR001007 // von Willebrand factor, type C /// IPR003129 // Thrombospondin, N-terminal /// IPR003367 // Thrombospondin type 3 repeat /// IPR008859 // Thrombospondin, C-terminal /// IPR008085 // Thrombospondin, subtype 1 /// IPR000742 // EGF-like domain, subtype 2 /// IPR006210 // Type I EGF | | | | | |
| 47 | IPR000357 // HEAT /// IPR008938 // ARM repeat fold | | GI:1894430; GDB:G00-125-284 | * See below | cytosol; membrane; microtubule cytoskeleton; mitochondrion; nucleus; protein phosphatase type 2A complex; soluble fraction | antigen binding; protein binding; protein heterodimerization activity; protein phosphatase type 2A activity; protein phosphatase type 2A regulator activity |
| | | | RNA splicing; ceramide metabolism; inactivation of MAPK; induction of apoptosis; negative regulation of cell growth; negative regulation of tyrosine phosphorylation of Stat3 protein; protein amino acid dephosphorylation; protein complex assembly; regulation of DNA replication; regulation of Wnt receptor signaling pathway; regulation of cell adhesion; regulation of cell cycle; regulation of cell differentiation; regulation of growth; regulation of transcription; regulation of translation; response to organic substance; second-messenger-mediated signaling | | | |
| 48 | IPR008028 // Sarcolipin | NP_003054 // 0.95505 | GeneID:6588; LocusID:6588; MIM:602203; GI:45070063 | transport | integral to membrane; sarcoplasmic reticulum; smooth endoplasmic reticulum | enzyme regulator activity |

Figure 3E.4

| | | | | |
|---|---|---|---|---|
| 49 | IPR003961 // Fibronectin, type III /// IPR001611 // Leucine-rich repeat /// IPR000372 // Cysteine-rich flanking region, N-terminal /// IPR001211 // Phospholipase A2 /// IPR003591 // Leucine-rich repeat, typical subtype | NP_037413 // 1 // 0.36996 /// NP_938205 /// 1 // 0.36996 | GeneID:23767; LocusID:23767; MIM:604808; GI:7019383 | cell adhesion | extracellular matrix; integral to plasma membrane | protein binding; bridging; receptor signaling protein activity |
| 50 | IPR001356 // Homeobox /// IPR009057 // Homeodomain-like | | GeneID:3229; LocusID:3229; MIM:142976; GI:24497536 | morphogenesis; regulation of transcription, DNA-dependent | nucleus | RNA polymerase II transcription factor activity |
| 51 | IPR000357 // HEAT /// IPR008938 // ARM repeat fold | | | | | |
| 52 | IPR004841 // Amino acid permease-associated region /// IPR022293 // Amino acid/polyamine transporter I /// IPR004760 // L-type amino acid transporter | NP_055146 // 11 // 0.99636 | GI:13516846 | amino acid transport; protein complex assembly | integral to membrane | amino acid permease activity; cystine:glutamate antiporter activity |
| 53 | --- | --- | | cell growth and/or maintenance | cellular_component unknown | molecular_function unknown |
| 54 | IPR004841 // Amino acid permease-associated region /// IPR022293 // Amino acid/polyamine transporter I /// IPR004760 // L-type amino acid transporter | NP_036376 // 12 // 0.99614 /// NP_877392 // 6 // 0.29518 | | | | |
| 55 | IPR001356 // Homeobox /// IPR001781 // Zn-binding protein, LIM /// IPR007107 // LIM homeobox /// IPR009057 // Homeodomain-like | | GI:508712 | regulation of transcription, DNA-dependent | nucleus | transcription factor activity; zinc ion binding |
| 56 | IPR000073 // Alpha/beta hydrolase fold /// IPR000639 // Epoxide hydrolase /// IPR000379 // Esterase/lipase/thioesterase | NP_002393 // 1 // 0.99602 | GeneID:4232; LocusID:4232; MIM:601029; GI:29294639 | response to toxin; xenobiotic metabolism | | epoxide hydrolase activity |
| 57 | IPR008661 // L6 membrane | NP_055035 // 4 // 0.99925 | | | | |
| 58 | IPR000357 // HEAT /// IPR008938 // ARM repeat fold | | GeneID:5519; LocusID:5519; MIM:603113; GI:32455246 | *see below | cytosol; membrane; microtubule cytoskeleton; mitochondrion; nucleus; protein phosphatase type 2A complex; soluble fraction | antigen binding; protein binding; protein heterodimerization activity; protein phosphatase type 2A activity; protein phosphatase type 2A regulator activity |

Figure 3E.5

| | | | |
|---|---|---|---|
| | | RNA splicing; ceramide metabolism; inactivation of MAPK; induction of apoptosis; negative regulation of cell growth; negative regulation of tyrosine phosphorylation of Stat3 protein; protein amino acid dephosphorylation; protein complex assembly; regulation of DNA replication; regulation of Wnt receptor signaling pathway; regulation of cell adhesion; regulation of cell cycle; regulation of cell differentiation; regulation of growth; regulation of transcription; regulation of translation; response to organic substance; second-messenger-mediated signaling | |
| 59 | IPR003961 // Fibronectin, type III /// IPR002996 // Cytokine receptor, common beta/gamma chain /// IPR008957 // Fibronectin, type III-like fold | GeneID:9244; LocusID:9244; MIM:604237; GI:4758062 | |
| 60 | IPR000095 // PAK-box/P21-Rho-binding /// IPR009099 // beta-lactamase-inhibitor protein BLIP | | |
| 61 | IPR000566 // Lipocalin-related protein and Bos/Can/Equ allergen /// IPR000463 // Cytosolic fatty-acid binding protein | GeneID:2167; LocusID:2167; MIM:600434; GI:4557579 | |
| 62 | IPR001356 // Homeobox /// IPR000047 // Helix-turn-helix motif, lambda-like repressor /// IPR009057 // Homeodomain-like | GI:17722694 | development; regulation of transcription, DNA-dependent; skeletal development | transcription factor activity |
| 63 | IPR001751 // Calcium-binding protein, S-100/ICaBP type /// IPR002048 // Calcium-binding EF-hand | | | calcium ion binding; protein binding |
| 64 | IPR001050 // Syndecan /// IPR003585 // Neurexin/syndecan/glycophorin C | NP_002989 // 1 // 0.11417 | | nucleus |
| 65 | IPR008408 // Brain acid soluble protein 1 | GeneID:6286; LocusID:6286; MIM:600614; GI:5174663 | | |
| 66 | | GeneID:10409; LocusID:10409; MIM:605940; GI:30795231 | | cytoskeleton; plasma membrane |
| 67 | IPR000095 // PAK-box/P21-Rho-binding /// IPR009099 // beta-lactamase-inhibitor protein BLIP | GI:68076669; TrEMBL:Q9UKI2 | signal transduction | |
| 68 | IPR007110 // Immunoglobulin-like /// IPR000884 // Thrombospondin, type I /// IPR000488 // Death domain /// IPR000906 // ZU5 domain /// IPR008085 // Thrombospondin, subtype 1 /// IPR003598 // Immunoglobulin C-2 type /// IPR003599 // Immunoglobulin subtype | NP_734465 // 1 // 0.27239 | | cytoskeletal regulatory protein binding |

Figure 3E.6

| | | | | |
|---|---|---|---|---|
| 69 | IPR008081 // Cytoplasmic fragile X mental retardation protein interacting protein /// IPR001811 // Small chemokine, interleukin-8 like | | GI:7328001; TrEMBL:Q9NSN1 | immune response | extracellular | chemokine activity |
| 70 | IPR007110 // Immunoglobulin-like /// IPR003598 // Immunoglobulin C-2 type /// IPR003599 // Immunoglobulin subtype /// IPR000634 // Serine/threonine dehydratase, pyridoxal-phosphate-binding site | | | | |
| 71 | IPR001356 // Homeobox /// IPR000047 // Helix-turn-helix motif, lambda-like repressor /// IPR009057 // Homeodomain-like | | GeneID:4487; LocusID:4487; MIM:142983; GI:45052567 | development; regulation of transcription, DNA-dependent; skeletal development | nucleus | transcription factor activity |
| 72 | IPR001839 // Transforming growth factor beta /// IPR001111 // Transforming growth factor beta (TGFb), N-terminal /// IPR002405 // Inhibin, alpha subunit | | | | | |
| 73 | IPR004841 // Amino acid permease-associated region /// IPR002293 // Amino acid/polyamine transporter I /// IPR004760 // L-type amino acid transporter | NP_036376 // 12 // 0.99614 /// NP_877392 // 6 // 0.29518 | | | | |
| 74 | IPR000668 // Peptidase C1A, papain /// IPR000169 // Peptidase, eukaryotic cysteine peptidase active site | | GI:3228672 | proteolysis and peptidolysis | lysosome | cathepsin L activity; hydrolase activity |
| 75 | | | | | | |
| 76 | IPR002048 // Calcium-binding EF-hand /// IPR001125 // Recoverin | | GI:4104814 | | | |
| 77 | IPR004157 // Organic anion transporter polypeptide (OATP), C-terminal /// IPR002350 // Serine protease inhibitor, Kazal type /// IPR004156 // Organic anion transporter polypeptide (OATP), N-terminal | NP_037404 // 11 // 0.97306 | GeneID:28232; LocusID:28232; GI:7019531 | ion transport | integral to membrane | transporter activity |
| 78 | IPR007062 // Protein phosphatase inhibitor 2 (IPP-2) | | GeneID:5504; LocusID:5504; MIM:601792; GI:5453946 | | | |
| 79 | IPR002076 // GNS1/SUR4 membrane protein | NP_076995 // 6 // 0.58832 | GeneID:79071; LocusID:79071; GI:13129088 | | integral to membrane | |
| 80 | IPR000719 // Protein kinase /// IPR008271 // Serine/threonine protein kinase, active site /// IPR001245 // Tyrosine protein kinase /// IPR002290 // Serine/threonine protein kinase | | | | | |
| 81 | IPR003380 // Transforming protein Ski /// IPR009061 // Putative DNA binding | | GeneID:1602; LocusID:1602; MIM:603803; GI:18375609 | cell growth and/or maintenance; development; regulation of transcription, DNA-dependent | nucleus | DNA binding |
| 82 | IPR002048 // Calcium-binding EF-hand /// IPR001125 // Recoverin | | GeneID:7447; LocusID:7447; MIM:600817; GI:21361559 | | | |

Figure 3E.7

| | | | | |
|---|---|---|---|---|
| 83 | IPR002350 // Serine protease inhibitor, Kazal type /// IPR000716 // Thyroglobulin type-1 /// IPR006209 // EGF-like domain | | GI:7248845 | | cell adhesion; cell motility; cell proliferation; development; neurogenesis | extracellular matrix; extracellular space | |
| 84 | IPR000242 // Tyrosine specific protein phosphatase /// IPR000387 // Tyrosine specific protein phosphatase and dual specificity protein phosphatase | | | | | |
| 85 | IPR003008 // Tubulin/FtsZ, GTPase /// IPR008280 // Tubulin/FtsZ, C-terminal /// IPR000217 // Tubulin /// IPR002453 // Beta tubulin | | GeneID:7280; LocusID:7280; MIM:191130; GI:4507729 | | | | |
| 86 | IPR001128 // Cytochrome P450 /// IPR002401 // E-class P450, group I | | | | | | |
| 87 | IPR002048 // Calcium-binding EF-hand /// IPR001715 // Calponin-like actin-binding /// IPR002017 // Spectrin repeat /// IPR001589 // Actin-binding, actinin-type | | LocusID:87; MIM:102575; GI:13097756 | | | actin cytoskeleton | actin binding; calcium ion binding; structural constituent of cytoskeleton |
| 88 | IPR006209 // EGF-like domain /// IPR002212 // Matrix fibril-associated /// IPR000152 // Aspartic acid and asparagine hydroxylation site /// IPR001881 // EGF-like calcium-binding /// IPR000742 // EGF-like domain, subtype 2 /// IPR009030 // Growth factor, receptor | | GeneID:4053; LocusID:4053; MIM:602091; GI:4557733 | | extracellular transport; protein secretion; protein targeting; regulation of cell cycle; transforming growth factor beta receptor signaling pathway | extracellular matrix; extracellular space | calcium ion binding; growth factor binding |
| 89 | IPR010533 // Vertebrate interleukin-3 regulated transcription factor /// IPR004827 // Basic-leucine zipper (bZIP) transcription factor | | GeneID:4783; LocusID:4783; MIM:605327; GI:4885517 | | immune response; regulation of transcription, DNA-dependent; transcription from Pol II promoter | nucleus | DNA binding; transcription corepressor activity; transcription factor activity |
| 90 | IPR000276 // Rhodopsin-like GPCR superfamily | NP_031395 // 7 /// 0.00298 /// NP_722561 // 7 /// 0.00298 | | | | | |
| 91 | IPR001079 // Galectin, galactose-binding lectin /// IPR008985 // Concanavalin A-like lectin/glucanase | | GeneID:3956; LocusID:3956; MIM:150570; GI:45044981 | | apoptosis; heterophilic cell adhesion; positive regulation of I-kappaB kinase/NF-kappaB cascade | | signal transducer activity; sugar binding |
| 92 | IPR001664 // Intermediate filament protein /// IPR003054 // Type II keratin | | GI:908805 | | cytoskeleton organization and biogenesis; ectoderm development | intermediate filament | structural constituent of cytoskeleton; structural molecule activity |

Figure 3E.8

| # | Description | Accession | IDs | Process | Location | Function |
|---|---|---|---|---|---|---|
| 93 | IPR001849 // Pleckstrin-like /// IPR001478 // PDZ/DHR/GLGF domain /// IPR000219 // DH domain /// IPR003116 // Raf-like Ras-binding /// IPR011331 // Guanine-nucleotide dissociation stimulator, CDC24 | | | | | |
| 94 | IPR007110 // Immunoglobulin-like /// IPR003598 // Immunoglobulin C-2 type /// IPR003599 // Immunoglobulin subtype /// IPR000634 // Serine/threonine dehydratase, pyridoxal-phosphate-binding site | | | | | |
| 95 | IPR000819 // Peptidase M17, cytosol aminopeptidase, C-terminal /// IPR008283 // Peptidase M17, cytosol aminopeptidase, N-terminal | NP_071286 // 2 // 0.94022 | GeneID:51056; LocusID:51056; MIM:170250; GI:41393561 | proteolysis and peptidolysis | | hydroase activity; leucyl aminopeptidase activity; magnesium ion binding; manganese ion binding; prolyl aminopeptidase activity; zinc ion binding |
| 96 | IPR000272 // FXYD protein | | GeneID:53826; LocusID:53826; MIM:6066683; GI:116126655 | ion transport | cytoplasm; integral to membrane | ion channel activity |
| 97 | IPR001327 // FAD-dependent pyridine nucleotide-disulphide oxidoreductase /// IPR004099 // Pyridine nucleotide-disulphide oxidoreductase dimerisation domain /// IPR011100 // Pyridine nucleotide-disulphide oxidoreductase, class 1 /// IPR000815 // Mercuric reductase /// IPR000205 // NAD-binding site /// IPR006338 // Thioredoxin and glutathione reductase selenoprotein | | | | | |
| 98 | IPR006931 // Calcipressin | | | | | |
| 99 | IPR001050 // Syndecan /// IPR003585 // Neurexin/syndecan/glycophorin C | NP_002988 // 1 // 0.38185 | GI:6660052; GOA:P18827; Swiss-Prot:P18827 | | integral to plasma membrane | cytoskeletal protein binding |
| 100 | --- | NP_037362 // 1 // 0.92477 | GI:3961168; GOA:P25063; Swiss-Prot:P25063 | humoral immune response | plasma membrane | |
| 101 | IPR002946 // Intracellular chloride channel /// IPR004046 // Glutathione S-transferase, C-terminal | | | | | |
| 102 | IPR006018 // Caldesmon and lymphocyte specific protein /// IPR006017 // Caldesmon /// IPR006162 // Phosphopantetheine attachment site | | | | | |
| 103 | IPR003090 // Crystallin, N-terminal /// IPR002068 // Heat shock protein Hsp20 /// IPR014436 // Alpha crystallin /// IPR008978 // HSP20-like chaperone | | GI:2852648 | muscle contraction; protein folding; visual perception | cytoplasm; nucleus of eye lens | chaperone activity; structural constituent of eye lens |

Figure 3E.9

| # | | | | |
|---|---|---|---|---|
| 104 | IPR000562 // Type II fibronectin collagen-binding domain /// IPR001304 // C-type lectin /// IPR002353 // Type II antifreeze protein /// IPR000566 // Lipocalin-related protein and Bos/Can/Equ allergen /// IPR000772 // Ricin B lectin domain /// IPR008997 // Ricin B-related lectin | NP_006030 // 1 // 5.2E-4 | GI:40788335 | | kinase activity; receptor activity; sugar binding |
| 105 | IPR007110 // Immunoglobulin-like /// IPR003598 // Immunoglobulin C-2 type /// IPR003599 // Immunoglobulin subtype /// IPR000634 // Serine/threonine dehydratase, pyridoxal-phosphate-binding site | | GeneID:23022; LocusID:23022; MIM:608092; GI:21361585 | | |
| 106 | IPR002048 // Calcium-binding EF-hand /// IPR001715 // Calponin-like actin-binding /// IPR002017 // Spectrin repeat /// IPR001589 // Actin-binding, actinin-type | | | | |
| 107 | IPR002735 // Translation initiation factor IF5 /// IPR003307 // eIF4-gamma/eIF5/eIF2-epsilon | | GI:52625527; GOA:P55010; Swiss-Prot:P55010 | | protein biosynthesis; regulation of translational initiation |
| 108 | IPR001664 // Intermediate filament protein /// IPR002957 // Keratin, type I | | GeneID:3872; LocusID:3872; MIM:148069; GI:4557701 | cytosol | GTP binding; GTPase activity; translation initiation factor activity |
| 109 | IPR000832 // G-protein coupled receptor family 2 (secretin-like) /// IPR006209 // EGF-like domain /// IPR002126 // Cadherin /// IPR002049 // Laminin-type EGF-like domain /// IPR001791 // Laminin G /// IPR000203 // GPS domain /// IPR001879 // Hormone receptor, extracellular /// IPR000152 // Aspartic acid and asparagine hydroxylation site /// IPR000742 // EGF-like domain, subtype 2 /// IPR001881 // EGF-like calcium-binding /// IPR001368 // TNFR/CD27/30/40/95 cysteine-rich region /// IPR008985 // Concanavalin A-like lectin/glucanase | NP_001399 // 7 // 0.02449 | GeneID:1952; LocusID:1952; MIM:604265; GI:13325064 GeneID:65108; LocusID:65108; MIM:602940; GI:13491174 | integral to membrane | development; homophilic cell adhesion; neuropeptide signaling pathway |
| 110 | IPR002101 // Myristoylated alanine-rich C-kinase substrate MARCKS | | GI:3339944 | | G-protein coupled receptor activity; calcium ion binding; structural molecule activity |
| 111 | | | | | |
| 112 | IPR006139 // D-isomer specific 2-hydroxyacid dehydrogenase, catalytic domain /// IPR006140 // D-isomer specific 2-hydroxyacid dehydrogenase, NAD binding domain /// IPR001588 // Casein, alpha/beta /// IPR006236 // D-3-phosphoglycerate dehydrogenase | | GeneID:26227; LocusID:26227; MIM:606879; GI:23308577 | | L-serine biosynthesis; brain development | electron transporter activity; oxidoreductase activity; phosphoglycerate dehydrogenase activity |

Figure 3E.10

| # | Domain | ID | Process | Location | Function |
|---|---|---|---|---|---|
| 113 | IPR000910 // HMG1/2 (high mobility group) box /// IPR009071 // High mobility group box | GeneID:6662; LocusID:6662; MIM:608160; GI:4557853 | cartilage condensation; regulation of transcription from Pol II promoter | nucleus | DNA binding; specific RNA polymerase II transcription factor activity |
| 114 | IPR007110 // Immunoglobulin-like /// IPR000884 // Thrombospondin, type 1 /// IPR000488 // Death domain /// IPR000906 // ZU5 domain /// IPR008085 // Thrombospondin, subtype 1 /// IPR003598 // Immunoglobulin C-2 type /// IPR001881 // Immunoglobulin subtype | NP_734465 // 1 // 0.27239 | | | |
| 115 | IPR001660 // Sterile alpha motif SAM | | | | |
| 116 | IPR002068 // Heat shock protein Hsp20 /// IPR001436 // Alpha crystallin /// IPR008978 // HSP20-like chaperone | GeneID:3315; LocusID:3315; MIM:602195; GI:4504517 | regulation of translational initiation | cytoplasm | heat shock protein activity |
| 117 | IPR006209 // EGF-like domain /// IPR001774 // Delta/Serrate/lag-2 (DSL) protein /// IPR001438 // Type II EGF-like signature /// IPR000152 // Aspartic acid and asparagine hydroxylation site /// IPR001881 // EGF-like calcium-binding /// IPR000742 // EGF-like domain, subtype 2 /// IPR001007 // von Willebrand factor, type C | NP_000205 // 1 // 0.11274 | Notch signaling pathway; angiogenesis; cell communication; cell fate determination; development; endothelial cell differentiation; hemopoiesis; keratinocyte differentiation; myoblast differentiation; neurogenesis; regulation of cell migration; regulation of cell proliferation | extracellular; integral to plasma membrane | Notch binding; calcium ion binding; growth factor activity; structural molecule activity |
| 118 | IPR006608 // Ubiquitin-conjugating enzymes | GI:1695274 | | | |
| 119 | IPR001711 // Phosphatidylinositol-specific phospholipase C, Y domain /// IPR002048 // Calcium-binding EF-hand /// IPR000008 // C2 domain /// IPR001849 // Pleckstrin-like /// IPR000909 // Phosphatidylinositol-specific phospholipase C, X domain /// IPR001192 // Phosphoinositide-specific phospholipase C (PLC) /// IPR008973 // C2 calcium/lipid-binding domain, CaLB | GeneID:5333; LocusID:5333; MIM:602142; GI:5453910 | intracellular signaling cascade; lipid catabolism; phospholipid metabolism | | calcium ion binding; hydrolase activity; phosphoinositide phospholipase C activity; signal transducer activity |
| 120 | IPR011781 // Zn-binding protein, LIM | GeneID:7739; LocusID:7739; MIM:300381; GI:6005972 | | | |
| 121 | IPR003340 // Dual specificity protein phosphatase /// IPR000387 // Tyrosine specific protein phosphatase and dual specificity protein phosphatase | GeneID:11072; LocusID:11072; MIM:606618; GI:5902002 | protein amino acid dephosphorylation | | zinc ion binding hydrolase activity; protein tyrosine/serine/threonine phosphatase activity |

Figure 3E.11

| # | Description | ID | Process | Location | Function |
|---|---|---|---|---|---|
| 122 | IPR001628 // Zn-finger, C4-type steroid receptor /// IPR000536 // Ligand-binding domain of nuclear hormone receptor /// IPR000324 // Vitamin D receptor /// IPR001723 // Steroid hormone receptor /// IPR008946 // Steroid nuclear receptor, ligand-binding | | | | |
| 123 | IPR001680 // G-protein beta WD-40 repeat | GI:6807665; Swiss-Prot:Q9Y2I8 | | | |
| 124 | IPR000308 // 14-3-3 protein | | | | |
| 125 | IPR001293 // Zn-finger, TRAF type /// IPR008974 // TRAF domain-like | NP_116076 // 3 // 0.28446 | | | |
| 126 | IPR000195 // RabGAP/TBC domain | | | | |
| 127 | IPR001781 // Zn-binding protein, LIM | | GeneID:2274; LocusID:2274; MIM:602633; GI:42403585 | nucleus | |
| 127 | | | | | |
| 128 | IPR000533 // Tropomyosin /// IPR008374 // SF_assemblin /// IPR000794 // Beta-ketoacyl synthase | NP_061880 // 1 // 0.83145 | GI:8541189; TrEMBL::Q156S7 | muscle development; regulation of heart rate; regulation of muscle contraction | cytoskeleton; muscle thin filament tropomyosin | actin binding; structural constituent of cytoskeleton; structural constituent of muscle |
| 129 | DUF634 | | GI:7021129 | | | |
| 130 | IPR006047 // Alpha amylase, catalytic domain | NP_002385 // 1 // 0.98774 | GeneID:6520; LocusID:6520; MIM:158070; GI:21361344 | amino acid transport; carbohydrate metabolism; cell growth; sodium:calcium exchange | integral to membrane | alpha-amylase activity; amino acid transporter activity |
| 131 | IPR005026 // Guanylate-kinase-associated protein | | | | | |
| 132 | IPR003961 // Fibronectin, type III /// IPR001841 // Zn-finger, RING /// IPR003877 // SPIa/RYanodine receptor SPRY /// IPR000315 // Zn-finger, B-box /// IPR001870 // B302, (SPRY)-like /// IPR036649 // B-box, C-terminal /// IPR008957 // Fibronectin, type III-like fold | | GI:12407403 | | | |
| 133 | IPR002087 // Anti-proliferative protein | | | | | |
| 134 | IPR001079 // Galectin, galactose-binding lectin /// IPR008985 // Concanavalin A-like lectin/glucanase | | LocusID:3958; MIM:153619; GI:12654571 | epidermis development; | | |
| 135 | IPR000566 // Lipocalin-related protein and Bos/Can/Equ allergen /// IPR000463 // Cytosolic fatty-acid binding protein | | GeneID:2171; LocusID:2171; MIM:605168; GI:4557581 | lipid metabolism; transport | cytoplasm | fatty acid binding; transporter activity |
| 136 | IPR006627 // Protein of unknown function TDU | | | | | |

Figure 3E.12

| | | | | |
|---|---|---|---|---|
| 137 | IPR000533 // Tropomyosin | --- | LocusID:7171; MIM:600317; GI:128039959 | | cytoskeleton; muscle thin filament tropomyosin | actin binding; structural constituent of muscle |
| 138 | IPR001609 // Myosin head (motor domain) /// IPR000048 // IQ calmodulin-binding region /// IPR010926 // Myosin tail 2 | --- | | muscle development | | |
| 139 | IPR007087 // Zn-finger, C2H2 type | --- | GeneID:5324; LocusID:5324; MIM:603026; GI:45058855 | | nucleus | nucleic acid binding; transcription factor activity; zinc ion binding |
| 140 | IPR001452 // SH3 /// IPR001849 // Pleckstrin-like | --- | GI:4062960 | protein complex assembly; signal transduction | | SH3/SH2 adaptor protein activity |
| 141 | IPR004046 // Glutathione S-transferase, C-terminal /// IPR004045 // Glutathione S-transferase, N-terminal /// IPR003080 // Glutathione S-transferase, alpha class /// IPR003082 // Glutathione S-transferase, Pi class | --- | GeneID:2950; LocusID:2950; MIM:134660; GI:4504183 | | | |
| 142 | IPR001715 // Calponin-like actin-binding | --- | GI:8119288 | muscle development; smooth muscle contraction | actin cytoskeleton | actin binding; structural constituent of muscle |
| 143 | IPR000668 // Peptidase C1A, papain /// IPR001169 // Peptidase, eukaryotic cysteine peptidase active site | --- | GeneID:1508; LocusID:1508; MIM:116810; GI:45203139 | proteolysis and peptidolysis | intracellular; lysosome | cathepsin B activity; hydrolase activity |
| 144 | IPR0022867 // Zn-finger, cysteine-rich C6HC | NP_699172 // 2 // 0.01817 | | | | |
| 145 | IPR000566 // Lipocalin-related protein and Bos/Can/Equ allergen /// IPR000463 // Cytosolic fatty-acid binding protein | --- | GeneID:5947; LocusID:5947; MIM:180260; GI:4506451 | | | |
| 146 | IPR007110 // Immunoglobulin-like | --- | LocusID:9848; GI:12654871 | | | |
| 147 | IPR002110 // Ankyrin /// IPR000488 // Death domain /// IPR009906 // ZU5 domain /// IPR010106 // Conserved hypothetical protein 1784 | --- | GI:12052940; GOA:Q9H0P5; TrEMBL:Q9H0P5 | cytoskeletal anchoring; protein targeting; signal transduction | Golgi apparatus; cytoskeleton; endoplasmic reticulum | structural constituent of cytoskeleton |
| 148 | IPR001664 // Intermediate filament protein /// IPR003054 // Type II keratin /// IPR000873 // AMP-dependent synthetase and ligase | --- | GeneID:3852; LocusID:3852; MIM:148040; GI:4557890 | epidermis development | intermediate filament | structural constituent of cytoskeleton |

Figure 3E.13

| # | Description | ID | | | |
|---|---|---|---|---|---|
| 149 | IPR000014 // PAS domain /// IPR010011 // Protein of unknown function DUF1518 /// IPR002048 // Calcium-binding EF-hand /// IPR001092 // Basic helix-loop-helix dimerization domain bHLH /// IPR001610 // PAC motif /// IPR008955 // Nuclear receptor coactivator Src-1 /// IPR009110 // Nuclear receptor coactivator, interlocking | -- | GeneID:10499; LocusID:10499; MIM:601993; GI:57229858 | regulation of transcription, DNA-dependent; signal transduction | nucleus | signal transducer activity; transcription coactivator activity |
| 150 | IPR002558 // I/LWEQ domain /// IPR001026 // Epsin N-terminal homology /// IPR000533 // Tropomyosin /// IPR006077 // Vinculin/alpha-catenin /// IPR008943 // Phosphoinositide-binding clathrin adaptor, N-terminal | -- | GI:3327124 | biological process unknown | clathrin-coated vesicle; coated pit | actin binding |
| 151 | IPR002048 // Calcium-binding EF-hand /// IPR000886 // Endoplasmic reticulum targeting sequence | -- | LocusID:5955; MIM:602584; GI:134361152 | | endoplasmic reticulum | calcium ion binding; protein binding |
| 152 | -- | NP_003489 // 1 /// 0.04513 | GI:3978242 | response to abiotic stimulus; response to stress | integral to membrane | |
| 153 | IPR003010 // Nitrilase/cyanide hydratase and apolipoprotein N-acyltransferase | -- | | | | |
| 154 | IPR002126 // Cadherin /// IPR000233 // Cadherin cytoplasmic region | NP_004351 // 1 /// 3.7E-4 | GeneID:999; LocusID:999; MIM:192090; GI:4757960 | cell adhesion; homophilic cell adhesion | integral to membrane | calcium ion binding; protein binding |
| 155 | IPR004000 // Actin/actin-like /// IPR004001 // Actin | -- | | | | |
| 156 | IPR000719 // Protein kinase /// IPR008271 // Serine/threonine protein kinase, active site /// IPR001245 // Tyrosine protein kinase /// IPR002290 // Serine/threonine protein kinase | -- | GeneID:1456; LocusID:1456; MIM:604253; GI:4758080 | protein amino acid phosphorylation | | ATP binding; protein serine/threonine kinase activity |
| 157 | IPR001092 // Basic helix-loop-helix dimerization domain bHLH /// IPR009057 // Homeodomain-like /// IPR005542 // PBX domain | -- | LocusID:3861; MIM:148066; GI:128037709 | biological process unknown | | |
| 158 | IPR001664 // Intermediate filament protein /// IPR002957 // Keratin, type I /// IPR020040 // Tachykinin/Neurokinin | -- | | | intermediate filament | structural constituent of epidermis |
| 159 | IPR004000 // Actin/actin-like /// IPR004001 // Actin | -- | | | | |
| 160 | IPR002190 // MAGE protein | -- | GI:9963810 | | | |

Figure 3E.14

| # | Domain | ID | Process | Location | Function |
|---|---|---|---|---|---|
| 161 | IPR001452 // SH3 | GI:1490787 | cell adhesion; cytoskeleton organization and biogenesis; integrin-mediated signaling pathway; mitosis; regulation of cell cycle; regulation of cell growth; signal transduction | cytoskeleton; perinuclear space; spindle | actin bundling activity; protein binding |
| 162 | --- | --- | | | |
| 163 | IPR002308 // Cysteinyl-tRNA synthetase, class Ia /// IPR001412 // Aminoacyl-tRNA synthetase, class I /// IPR009080 // Aminoacyl-tRNA synthetase, class Ia, anticodon-binding | --- | | | |
| 164 | IPR002937 // Amine oxidase /// IPR001613 // Flavin-containing amine oxidase /// IPR005829 // Sugar transporter superfamily /// IPR0002205 // NAD-binding site | --- | | | |
| 165 | IPR0040000 // Actin/actin-like /// IPR004001 // Actin | --- | | | |
| 166 | IPR001752 // Kinesin, motor region | GI:1695882 | cell proliferation; mitosis | chromosome, pericentric region; kinesin complex; nucleus | ATP binding; centromeric DNA binding; microtubule motor activity |
| 167 | IPR001762 // Disintegrin /// IPR001590 // Peptidase M12B, ADAM/reprolysin /// IPR006209 // EGF-like domain /// IPR006025 // Peptidase M, neutral zinc metallopeptidases, zinc-binding site /// IPR001818 // Peptidase M10A and M12B, matrixin and adamalysin /// IPR001368 // TNFR/CD27/30/40/95 cysteine-rich region | NP_003174 // 1 // 4.8E-4 /// NP_068604 // 1 // 8.4E-4 /// GeneID:6868; LocusID:6868; MIM:603639; GI:11497004 | cell-cell signaling; proteolysis and peptidolysis | integral to plasma membrane | hydrolase activity; metalloendopeptidase activity; zinc ion binding |
| 168 | IPR001087 // Lipolytic enzyme, G-D-S-L | LocusID:5049; MIM:602508; GI:12653259 | cell motility; lipid catabolism | cytoplasm; soluble fraction | 1-alkyl-2-acetylglycerophosphocholine esterase activity; hydrolase activity |
| 169 | IPR000836 // Phosphoribosyltransferase /// IPR0017754 // Orotidine 5'-phosphate decarboxylase /// IPR002375 // Purine/pyrimidine phosphoribosyl transferase /// IPR004467 // Orotate phosphoribosyl transferase | GI:2081620 | 'de novo' pyrimidine base biosynthesis; UMP biosynthesis; nucleoside metabolism; pyrimidine nucleotide biosynthesis | | lyase activity; orotate phosphoribosyltransferase activity; orotidine-5'-phosphate decarboxylase activity; transferase activity, transferring glycosyl groups |

Figure 3E.15

| # | Description | Accession | IDs | Process | Location | Function |
|---|---|---|---|---|---|---|
| 170 | IPR006073 // GTP1/OBG /// IPR009019 // KH domain, prokaryotic type /// IPR005225 // Small GTP-binding protein domain /// IPR005662 // GTP-binding protein Era | | | | | |
| 171 | --- | --- | | | | |
| 172 | IPR006662 // Thioredoxin type domain /// IPR008886 // Endoplasmic reticulum targeting sequence /// IPR006663 // Thioredoxin domain 2 | | LocusID:23071; GI:13529224 | | | |
| 173 | --- | | GeneID:8624; LocusID:8624; MIM:605296; GI:45050023 | regulation of transcription, DNA-dependent | integral to plasma membrane; membrane fraction | |
| 174 | IPR001202 // WW/Rsp5/WWP domain | | GI:108801594 | | nucleus | DNA binding; transcription coactivator activity |
| 175 | --- | | GeneID:79712; LocusID:79712; GI:40254965 | | | |
| 176 | IPR000242 // Tyrosine specific protein phosphatase /// IPR000387 // Tyrosine specific protein phosphatase and dual specificity protein phosphatase | NP_002819 // 1 // 0.16771 | GeneID:10404; LocusID:10404; GI:7706387 | | | |
| 177 | IPR007484 // Peptidase M28 /// IPR003137 // Protease-associated PA | NP_060776 // 2 // 0.94656 | GeneID:55287; LocusID:55287; GI:31542667 | | | |
| 178 | --- | NP_060935 // 1 // 0.77988 | GeneID:58848; LocusID:58848; GI:8923932 | | | |
| 179 | --- | | | | | |
| 180 | IPR008972 // Cupredoxin | | GeneID:262277; LocusID:262277; MIM:604319; GI:6912716 | telomerase-dependent telomere maintenance | chromosome, telomeric region; nucleus | |
| 181 | IPR011487 // Bromodomain /// IPR019165 // Zn-finger-like, PHD finger /// IPR000313 // PWWP domain /// IPR000345 // Cytochrome c heme-binding site | | GI:52626603; TrEMBL:Q9Y4Q3 | regulation of transcription, DNA-dependent | nucleus | |
| 182 | IPR034439 // ABC transporter /// IPR011865 // Ribosomal protein S2 /// IPR003593 // AAA ATPase | NP_005493 // 11 // 0.889 | GI:9755159 | cholesterol metabolism; phagocytosis, engulfment; transport | integral to plasma membrane; membrane fraction | DNA binding; ATP binding; ATP-binding cassette (ABC) transporter activity; anion transporter activity; sterol transporter activity |

Figure 3E.16

| | | | | |
|---|---|---|---|---|
| 183 | IPR005123 // 2OG-Fe(II) oxygenase superfamily /// IPR001440 // TPR repeat /// IPR006620 // Prolyl 4-hydroxylase, alpha subunit /// IPR008941 // TPR-like | | GeneID:5033; LocusID:5033; MIM:176710; GI:45055655 GeneID:25959; LocusID:25959; GI:31324547 | | oxidoreductase activity; oxidoreductase activity, acting on single donors with incorporation of molecular oxygen, incorporation of two atoms of oxygen; procollagen-proline 4-dioxygenase activity |
| 184 | IPR022110 // Ankyrin | | | endoplasmic reticulum | |
| 185 | IPR007110 // Immunoglobulin-like /// IPR003599 // Immunoglobulin subtype | | GeneID:9308; LocusID:9308; MIM:604534; GI:4757946 | defense response; humoral immune response; signal transduction | integral to plasma membrane |
| 186 | IPR009432 // Protein of unknown function DUF1075 | NP_055182 // 1 // 0.57706 | GeneID:26355; LocusID:26355; MIM:608017; GI:21361427 | | |
| 187 | --- | | GeneID:8337; LocusID:8337; MIM:142720; GI:4504251 | chromosome organization and biogenesis (sensu Eukarya); nucleosome assembly | chromosome; nucleosome; nucleus |
| 187 | | | | | DNA binding |
| 187 | | | | | |
| 188 | IPR001708 // 60 kDa inner membrane protein | NP_055006 // 4 // 0.00516 | LocusID:5018; MIM:601066; GI:37589026 | | |
| 189 | IPR000008 // C2 domain /// IPR001849 // Pleckstrin-like /// IPR001936 // Ras GTPase-activating protein /// IPR001562 // Tec/Btk domain /// IPR008936 // Rho GTPase activation protein /// IPR008973 // C2 calcium/lipid-binding domain, CaLB /// IPR008194 // DNA-directed RNA polymerase, 13-16 kDa subunit subfamily /// IPR008193 // DNA-directed RNA polymerase, 13 to 16 kDa subunit /// IPR009025 // RBP11-like subunit of RNA polymerase | | GI:6635197 | | |
| 190 | IPR003397 // Mitochondrial import inner membrane translocase, subunit Tim17/22 /// IPR005681 // Mitochondrial import inner membrane translocase, subunit Tim23 | NP_006318 // 3 // 0.59418 | GeneID:10431; LocusID:10431; MIM:605034; GI:5454122 | protein-mitochondrial targeting | inner membrane; integral to plasma membrane; mitochondrial inner membrane presequence translocase complex; mitochondrion; outer membrane | protein translocase activity |

Figure 3E.17

| | | | |
|---|---|---|---|
| 191 | IPR000719 // Protein kinase /// IPR003961 // Fibronectin, type III /// IPR007110 // Immunoglobulin-like /// IPR001245 // Tyrosine protein kinase /// IPR008266 // Tyrosine protein kinase, active site /// IPR003599 // Immunoglobulin subtype /// IPR0008957 // Fibronectin, type III-like fold /// IPR002290 // Serine/threonine protein kinase | NP_001690 // 1 // 0.09455 /// NP_068713 // 1 // 0.08415 | GeneID:558; LocusID:558; MIM:109135; GI:21536466 | |
| 192 | IPR000436 // Sushi domain/SCR domain/CCP module | | GeneID:3080; LocusID:3080; MIM:600889; GI:5031695 | extracellular space |
| 193 | IPR001666 // Phosphatidylinositol transfer protein | | | |
| 194 | IPR000738 // WHEP-TRS /// IPR002305 // Aminoacyl-tRNA synthetase, class Ib /// IPR002306 // Tryptophanyl-tRNA synthetase, class Ib /// IPR001412 // Aminoacyl-tRNA synthetase, class I /// IPR009068 // S15/NS1, RNA-binding | | GeneID:7453; LocusID:7453; MIM:191050; GI:4759316 | negative regulation of cell proliferation; protein biosynthesis; tryptophanyl-tRNA aminoacylation | cytoplasm; soluble fraction | ATP binding; ligase activity; tryptophan-tRNA ligase activity |
| 195 | IPR002198 // Short-chain dehydrogenase/reductase SDR /// IPR002347 // Glucose/ribitol dehydrogenase | | | | |
| 196 | IPR005547 // Longevity-assurance protein (LAG1) /// IPR006634 // TRAM, LAG1 and CLN8 homology | | | | |
| 197 | IPR007110 // Immunoglobulin-like /// IPR003006 // Immunoglobulin/major histocompatibility complex /// IPR003597 // Immunoglobulin C-type | | | | |
| 198 | IPR001039 // Major histocompatibility complex protein, class I /// IPR007110 // Immunoglobulin-like /// IPR003006 // Immunoglobulin/major histocompatibility complex /// IPR003597 // Immunoglobulin C-type | NP_002118 // 1 // 0.07424 | GI:7158865 | | |
| 199 | IPR003859 // Metazoa galactosyltransferase | NP_004767 // 1 // 0.99382 | GI:5911805; GOA:O43286; Swiss-Prot:O43286 | carbohydrate metabolism | Golgi apparatus; integral to membrane | galactosyltransferase activity; transferase activity, transferring glycosyl groups |
| 200 | IPR007651 // Lipin, N-terminal conserved region | | | | |
| 201 | IPR000668 // Peptidase C1A, papain /// IPR000169 // Peptidase, eukaryotic cysteine peptidase active site | | GeneID:1512; LocusID:1512; MIM:116820; GI:23110955 | proteolysis and peptidolysis | lysosome | cathepsin H activity; hydrolase activity |
| 202 | | | | | |
| 203 | IPR000533 // Tropomyosin /// IPR002017 // Spectrin repeat | | GeneID:7169; LocusID:7169; MIM:190990; GI:42476296 | muscle development | cytoskeleton; muscle thin filament tropomyosin | actin binding; structural constituent of muscle |

Figure 3E.18

| | | | | |
|---|---|---|---|---|
| 204 | IPR000353 // Class II histocompatibility antigen, beta chain, beta-1 domain /// IPR007110 // Immunoglobulin-like /// IPR003006 // Immunoglobulin/major histocompatibility complex /// IPR003597 // Immunoglobulin C-type | NP_072049 // 1 // 0.2194 | LocusID:3126; GI:13529056 | antigen presentation, exogenous antigen; antigen processing, exogenous antigen via MHC class II; immune response; signal transduction | integral to plasma membrane | MHC class II receptor activity |
| 205 | IPR000215 // Serpin | | GeneID:5176; LocusID:5176; MIM:172860; GI:39725934 | | | serine-type endopeptidase inhibitor activity |
| 206 | IPR000719 // Protein kinase /// IPR007110 // Immunoglobulin-like /// IPR009134 // Vascular endothelial growth factor receptor, VEGFR /// IPR008266 // Tyrosine protein kinase, active site /// IPR001824 // Receptor tyrosine kinase, class III /// IPR003598 // Tyrosine protein kinase /// IPR001245 // Tyrosine protein kinase /// IPR003598 // Immunoglobulin C-2 type | NP_002600 // 1 // 0.01153 | GeneID:5159; LocusID:5159; MIM:173410; GI:4505683 | cell proliferation; development; negative regulation of angiogenesis; neurogenesis; positive regulation of neurogenesis | extracellular | |
| 207 | IPR002126 // Cadherin /// IPR010221 // VCBS | NP_149091 // 1 // 0.13877 | | | | |
| 208 | IPR007229 // Nicotinate phosphoribosyltransferase and related /// IPR002088 // Protein prenyltransferase, alpha subunit | | GeneID:10135; LocusID:10135; GI:5031977 | cell-cell signaling; positive regulation of cell proliferation; pyridine nucleotide biosynthesis; signal transduction | | cytokine activity; nicotinate phosphoribosyltransferase activity |
| 209 | IPR001148 // Carbonic anhydrase, eukaryotic. | NP_001209 // 1 // 0.03121 | GeneID:771; LocusID:771; MIM:603263; GI:4502515 | one-carbon compound metabolism | integral to membrane | carbonate dehydratase activity; lyase activity; zinc ion binding |
| 210 | IPR001124 // Lipid-binding serum glycoprotein | | GeneID:5360; LocusID:5360; MIM:172425; GI:5453914 | lipid metabolism; lipid transport | extracellular | lipid binding |
| 211 | | | | | | |
| 212 | IPR001039 // Major histocompatibility complex protein, class I /// IPR007110 // Immunoglobulin-like /// IPR003006 // Immunoglobulin/major histocompatibility complex /// IPR003597 // Immunoglobulin C-type /// IPR010579 // MHC_I, C-terminal | NP_002108 // 1 // 0.20049 | GI:386911; GDB:G00-119-311 | antigen presentation, endogenous antigen; antigen processing, endogenous antigen via MHC class I; immune response; NLS-bearing substrate-nucleus import; immune response; protein amino acid phosphorylation; protein kinase cascade; signal transduction | integral to membrane | MHC class I receptor activity |
| 213 | IPR001452 // SH3 /// IPR001998 // Xylose isomerase | | GI:7416993 | | actin cytoskeleton; nucleus | protein binding; receptor binding |

Figure 3E.19

| | | | | |
|---|---|---|---|---|
| 214 | IPR006134 // DNA polymerase B domain /// IPR006133 // DNA polymerase B, exonuclease domain /// IPR006172 // DNA-directed DNA polymerase, family B /// IPR004578 // DNA polymerase (pol2) | --- | GeneID:5980; LocusID:5980; MIM:602776; GI:4506483 | DNA repair; DNA replication; DNA-dependent DNA replication | nucleus; zeta DNA polymerase complex | 3'-5' exonuclease activity; DNA binding; DNA-directed DNA polymerase activity; nucleotide binding; transferase activity; zeta DNA polymerase activity |
| 215 | IPR001039 // Major histocompatibility complex protein, class I /// IPR007110 // Immunoglobulin-like /// IPR003006 // Immunoglobulin/major histocompatibility complex /// IPR003597 // Immunoglobulin C-type | NP_002118 // 1 // 0.07424 | GI:1184468; GDB:G00-125-675 | | | |
| 216 | IPR001003 // MHC Class II alpha chain, alpha-1 domain /// IPR007110 // Immunoglobulin-like /// IPR003006 // Immunoglobulin/major histocompatibility complex /// IPR003597 // Immunoglobulin C-type | NP_061984 // 1 // 0.39077 | GI:188256; GDB:G00-120-641 | antigen presentation, exogenous antigen; antigen processing, exogenous antigen via MHC class II; immune response | integral to plasma membrane | MHC class II receptor activity |
| 217 | IPR000048 // IQ calmodulin-binding region | --- | GeneID:5121; LocusID:5121; MIM:601629; GI:54538858 | central nervous system development | | |
| 218 | IPR001811 // Small chemokine, interleukin-8 like /// IPR002473 // Small chemokine, C-X-C/Interleukin 8 /// IPR000827 // Small chemokine, C-C subfamily | --- | GI:23265516; GOA:P55774; Swiss-Prot:P55774 | antimicrobial humoral response (sensu Vertebrata); cell-cell signaling; chemotaxis; immune response; inflammatory response; response to biotic stimulus; signal transduction | extracellular cytoplasm; plasma membrane | chemokine activity |
| 219 | IPR002048 // Calcium-binding EF-hand | --- | GeneID:25801; LocusID:25801; MIM:607030; GI:6912388 | membrane fusion | | calcium ion binding |
| 220 | IPR001039 // Major histocompatibility complex protein, class I /// IPR007110 // Immunoglobulin-like /// IPR003006 // Immunoglobulin/major histocompatibility complex /// IPR003597 // Immunoglobulin C-type /// IPR010579 // MHC_I, C-terminal | NP_002108 // 1 // 0.20049 | | antigen presentation, endogenous antigen; antigen processing, endogenous antigen via MHC class I; immune response | integral to membrane | MHC class I receptor activity |
| 221 | IPR000048 // IQ calmodulin-binding region | --- | GeneID:84223; LocusID:84223; GI:14165288 | | | |
| 222 | IPR001820 // Tissue inhibitor of metalloproteinase /// IPR008993 // TIMP-like OB-fold | --- | GeneID:7076; LocusID:7076; MIM:305370; GI:45507509 | development; positive regulation of cell proliferation; proteolysis and peptidolysis | extracellular matrix | metalloendopeptidase inhibitor activity; metallopeptidase activity |
| 223 | IPR002035 // von Willebrand factor, type A /// IPR006587 // Vault protein inter-alpha-trypsin | --- | LocusID:4013; MIM:602929; GI:12654783 | | | |

Figure 3E.20

| # | Description | Accession | IDs | Process | Location | Function |
|---|---|---|---|---|---|---|
| 224 | IPR000353 // Class II histocompatibility antigen, beta chain, beta-1 domain /// IPR007110 // Immunoglobulin-like /// IPR003006 // Immunoglobulin/major histocompatibility complex /// IPR003597 // Immunoglobulin C-type | NP_002112 // 1 // 0.6911 | GeneID:3115; LocusID:3115; MIM:142858; GI:24797076 | antigen presentation, exogenous antigen; antigen processing, exogenous antigen via MHC class II; immune response | integral to membrane | MHC class II receptor activity |
| 225 | IPR001563 // Peptidase S10, serine carboxypeptidase /// IPR000379 // Esterase/lipase/thioesterase | --- | GeneID:54504; LocusID:54504; GI:22027518 | proteolysis and peptidolysis | | hydrolase activity; serine carboxypeptidase activity |
| 226 | IPR003961 // Fibronectin, type III /// IPR008957 // Fibronectin, type III-like fold /// IPR003962 // Fibronectin, type III subdomain /// IPR000562 // Type II fibronectin collagen-binding domain /// IPR000083 // Fibronectin, type I /// IPR006209 // EGF-like domain /// IPR002086 // Aldehyde dehydrogenase | --- | GI:31397; GOA:P02751; Swiss-Prot:P02751 | acute-phase response; cell adhesion; cell migration; response to wounding | extracellular | collagen binding; extracellular matrix structural constituent; heparin binding |
| 227 | IPR002198 // Short-chain dehydrogenase/reductase SDR /// IPR002347 // Glucose/ribitol dehydrogenase | --- | GI:1203982 | metabolism; prostaglandin metabolism | | 15-hydroxyprostaglandin dehydrogenase (NAD+) activity; electron transporter activity; oxidoreductase activity; prostaglandin-D synthase activity |
| 228 | IPR001611 // Leucine-rich repeat /// IPR000372 // Cysteine-rich flanking region, N-terminal /// IPR003591 // Leucine-rich repeat, typical subtype | --- | GI:5532413 | organogenesis | extracellular matrix | |
| 229 | IPR000326 // PA-phosphatase related phosphoesterase /// IPR0089834 // Acid phosphatase/vanadium-dependent haloperoxidase | NP_003704 // 6 // 0.99912 /// NP_803133 // 6 // 0.99912 | | | | acid phosphatase activity |
| 230 | IPR000560 // Histidine acid phosphatase | --- | GeneID:51205; LocusID:51205; GI:21359911 | | | |
| 231 | IPR007110 // Immunoglobulin-like /// IPR001003 // MHC Class II alpha chain, alpha-1 domain /// IPR003006 // Immunoglobulin/major histocompatibility complex /// IPR003597 // Immunoglobulin C-type | NP_291032 // 1 // 0.74669 | GI:7030089; GDB:G00-120-634 | antigen presentation, exogenous antigen; antigen processing, exogenous antigen via MHC class II; immune response | integral to plasma membrane | MHC class II receptor activity |
| 232 | IPR001346 // Interferon regulatory factor /// IPR009058 // Winged helix DNA-binding | --- | GeneID:3659; LocusID:3659; MIM:147575; GI:4504721 | immune response; negative regulation of cell cycle; regulation of transcription, DNA-dependent; transcription from Pol II promoter | nucleus | transcription factor activity |

Figure 3E.21

| # | Description | IDs | Process | Location | Function |
|---|---|---|---|---|---|
| 233 | IPR000323 // Copper type II, ascorbate-dependent monooxygenase /// IPR005018 // DOMON domain /// IPR000945 // Dopamine-beta-monooxygenase /// IPR008960 // CBD9-like /// IPR008977 // PHM/PNGase F Fold | GI:9988950 | catecholamine metabolism | | copper ion binding; dopamine beta-monooxygenase activity |
| | IPR003961 // Fibronectin, type III /// IPR000242 // Tyrosine specific protein phosphatase /// IPR000387 // Tyrosine specific protein phosphatase and dual specificity protein phosphatase /// IPR003595 // Protein tyrosine phosphatase, catalytic region /// | NP_002829 // 1 // 0.01067 /// NP_563578 // 1 // 0.043 /// NP_563579 | GI:34276; GOA:Q16614; | cell surface receptor linked signal transduction; protein amino acid dephosphorylation | integral to plasma membrane | hydrolase activity; transmembrane receptor protein tyrosine phosphatase activity |
| 234 | IPR008957 // Fibronectin, type III-like fold | // 1 // 0.01508 | TrEMBL:Q16614 | | | |
| 234 | | | | | | |
| 235 | IPR016841 // Zn-finger, RING /// IPR000315 // Zn-finger, B-box /// IPR003879 // Butyrophylin-like /// IPR001870 // B302, (SPRY)-like /// IPR003877 // SPIa/RYanodine receptor SPRY | | | | | |
| 236 | IPR001916 // Glycoside hydrolase, family 22 /// IPR000974 // Glycoside hydrolase, family 22, lysozyme | | | | | |
| 237 | IPR005562 // Type II fibronectin collagen-binding domain /// IPR001818 // Hemopexin repeat /// IPR006025 // Peptidase M, neutral zinc metallopeptidases, zinc-binding site /// IPR006026 // Peptidase, metallopeptidases /// IPR009070 // Peptidoglycan binding-like | | GeneID:4313; LocusID:4313; MIM:120360; GI:111342666 | collagen catabolism | extracellular matrix; extracellular space | calcium ion binding; gelatinase A activity; hydrolase activity; zinc ion binding |
| 238 | --- | | GeneID:57152; LocusID:57152; MIM:606119; GI:9966907 | biological process unknown | extracellular | cytokine activity |
| 239 | IPR002086 // Aldehyde dehydrogenase | | GeneID:216; LocusID:216; MIM:100640; GI:21361176 | | | |
| 240 | IPR004827 // Basic-leucine zipper (bZIP) transcription factor /// IPR000837 // Fos transforming protein /// IPR000209 // Peptidase S8 and S53, subtilisin, kexin, sedolisin /// IPR008917 // Eukaryotic transcription factor, DNA-binding | | GeneID:2354; LocusID:2354; MIM:164772; GI:5803017 | behavior; development; negative regulation of transcription from Pol II promoter; regulation of cell cycle; regulation of transcription, DNA-dependent | nucleus | DNA binding; transcription factor binding |
| 241 | IPR002227 // Tyrosinase /// IPR006209 // EGF-like domain /// IPR002049 // Laminin-type EGF-like domain /// IPR008922 // Di-copper centre-containing | NP_001913 // 1 // 0.00458 | | | | |

Figure 3E.22

| # | Description | ID | Process | Component | Function |
|---|---|---|---|---|---|
| 242 | IPR000566 // Lipocalin-related protein and Bos/Can/Equ allergen /// IPR002345 // Lipocalin /// IPR002972 // Prostaglandin D synthase | GeneID:5730; LocusID:5730; MIM:176803; GI:32171249 GI:4837723 | prostaglandin biosynthesis; regulation of circadian sleep/wake cycle, sleep; transport | Golgi apparatus; extracellular; membrane; nuclear membrane; rough endoplasmic reticulum | isomerase activity; prostaglandin-D synthase activity; retinoid binding; transporter activity |
| 243 | --- | --- | | | |
| 244 | IPR000971 // Globin /// IPR002337 // Beta haemoglobin /// IPR009050 // Globin-like | GI:13549112 | | | |
| 245 | IPR000971 // Globin /// IPR002338 // Alpha haemoglobin /// IPR002339 // Pi haemoglobin /// IPR009050 // Globin-like | GI:13650074 | oxygen transport | hemoglobin complex | oxygen transporter activity; protein binding |
| 246 | IPR000971 // Globin /// IPR002338 // Alpha haemoglobin /// IPR002339 // Pi haemoglobin /// IPR009050 // Globin-like | GeneID:3039; LocusID:3039; MIM:141800; GI:4504347 | oxygen transport | hemoglobin complex | oxygen transporter activity; protein binding |
| 247 | IPR000971 // Globin /// IPR002338 // Alpha haemoglobin /// IPR002339 // Pi haemoglobin /// IPR009050 // Globin-like | GI:4038450 | | | |
| 248 | IPR000971 // Globin /// IPR002338 // Alpha haemoglobin /// IPR002339 // Pi haemoglobin /// IPR009050 // Globin-like | LocusID:3040; MIM:141850; GI:135A3548 GI:28549; REMTREMBL:CAA23749 | | | |
| 249 | --- | | | | |
| 250 | IPR000971 // Globin /// IPR002338 // Alpha haemoglobin /// IPR002339 // Pi haemoglobin /// IPR009050 // Globin-like | | | | |
| 251 | IPR000971 // Globin /// IPR002337 // Beta haemoglobin /// IPR009050 // Globin-like | GI:179409 | oxygen transport | hemoglobin complex | oxygen transporter activity |

Figure 3E.23

A.
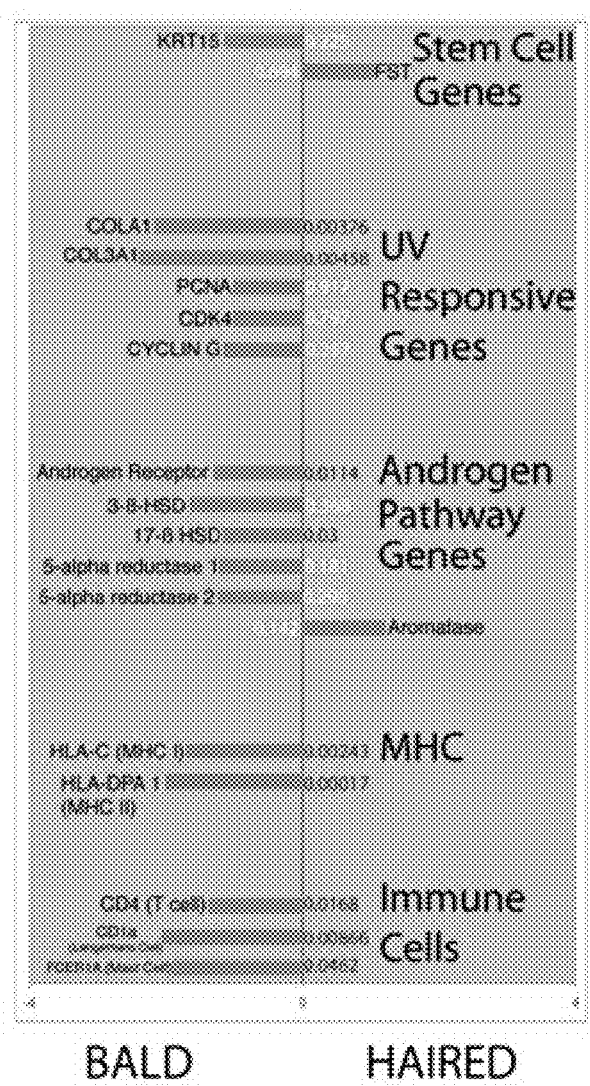
BALD      HAIRED
B.
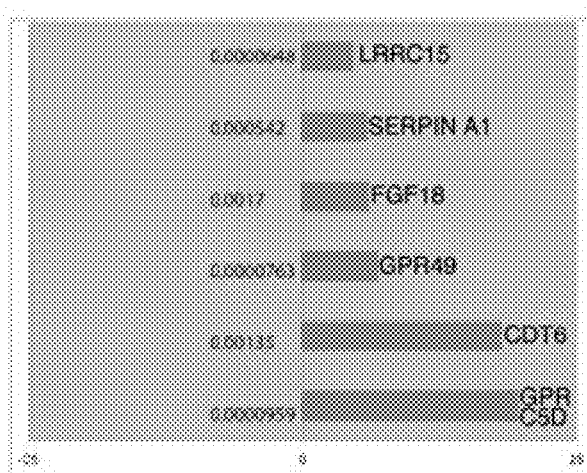
Figure 5

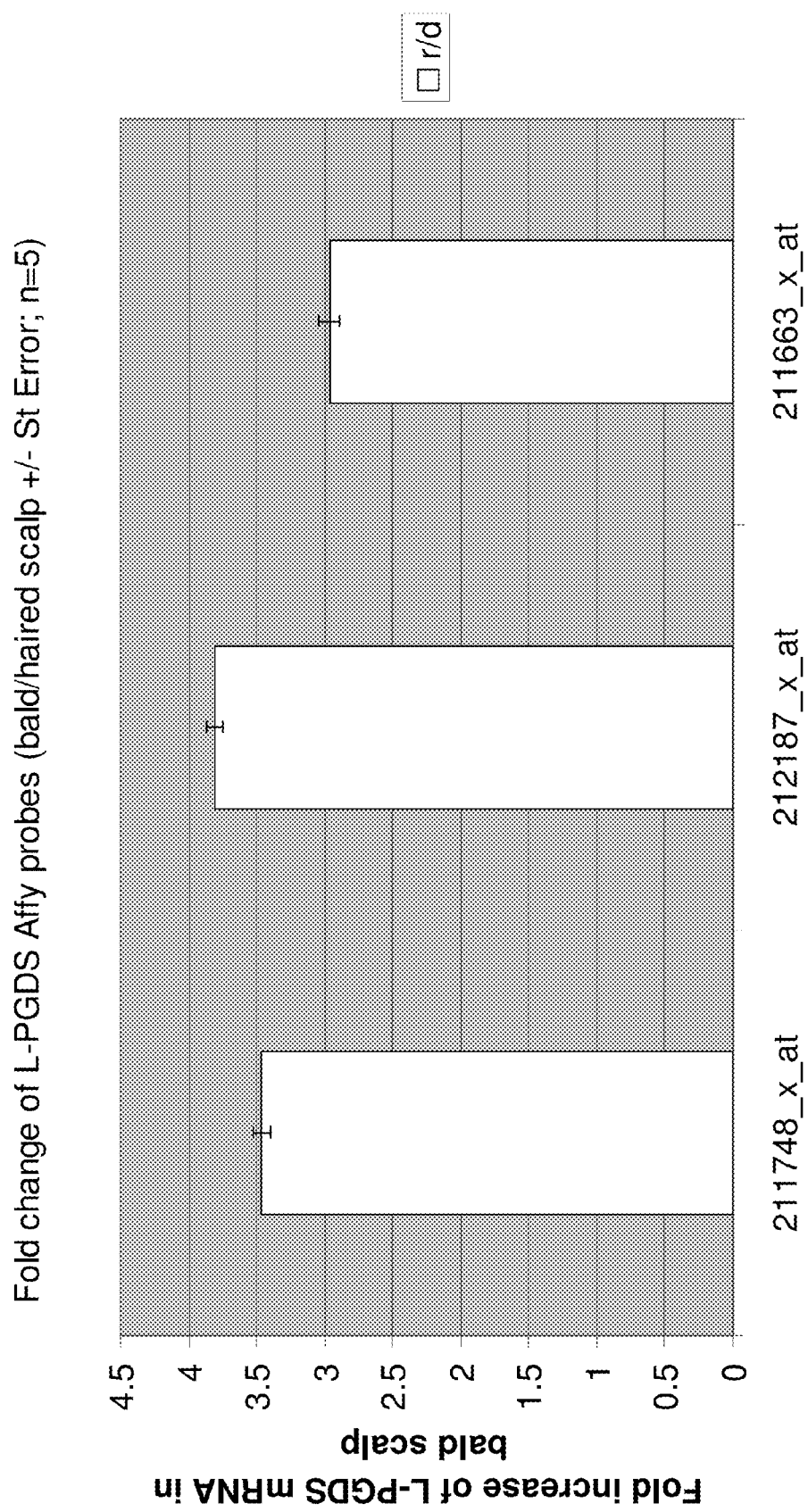

LRRC
F- 5' AAG TTT GCA GAG AGC AGA CAG C 3'
RT7- 5'GTA ATA CGA CTC ACT ATA GGG CGC TTT GAA GGC AGC ATG AAG GC 3'

CTD6F
F- 5' AGA GAA AGG AGT GAA GGA GGC AG 3'
RT7- 5' GTA ATA CGA CTC ACT ATA GGG CAG GAA GCT CCT TGA GCT TGT TTC 3'

CLADE/SERPIN
F- 5' GCC TTC ACC AGC AAG GCT GAC C   3'
RT7- 5' GTA ATA CGA CTC ACT ATA GGG CAT GGC CAC TAC GGT GCA CAG GG 3'

GPRC5D
F- 5' CAG CCA GTG GAA TGT CCT CCC C   3'
RT7- 5' GTA ATA CGA CTC ACT ATA GGG CCC AGA GCA ATG CAG ACG ACC G 3'

GPR49
F- 5' GGA CTC AAG AGA CTC AGT AAC G   3'
RT7- 5' GTA ATA CGA CTC ACT ATA GGG CCA AAG AAT ATG CCA CTG TAC AAG G 3'

FGF18
F- 5' GAA GCC CTT CAA GTA CAC GAC G   3'
RT7- 5' GTA ATA CGA CTC ACT ATA GGG CGG TTG ACT ACA GTC CCT TTG CG 3'

Figure 8

Figure 9D
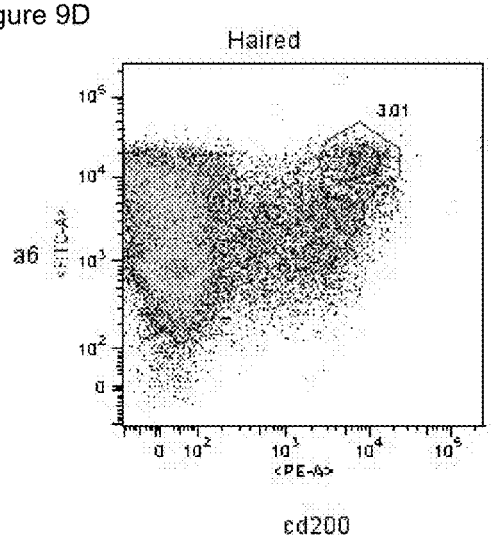
Figure 9E
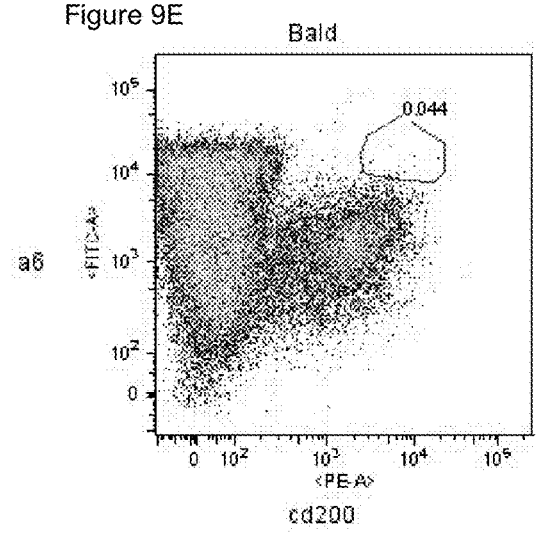
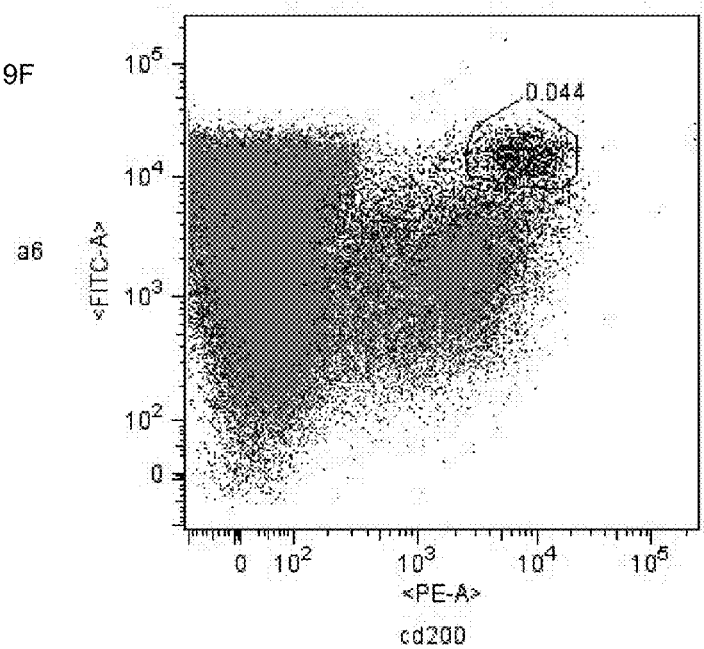
Figure 9F

| SEQ ID No: | Systematic | UniGene | 1E-07 p value | fold | Genbank | Common | Gene Title Affymetrix |
|---|---|---|---|---|---|---|---|
| 277 | 221297_at | Hs.283073 | 9 6.48E-05 | 19.553 | NM_018654 | GPRC5D | G protein-coupled receptor, family C, group 5, member D |
| 278 | 206423_at | Hs.146559 | 12 0.000542 | 18.082 | NM_021146 | CD76 | angiopoietin-like factor |
| | 207457_s_at | Hs.408316 | 13 0.000375 | 17.780 | | LY6G6D | lymphocyte antigen 6 complex, locus G6D |
| | 206027_at | Hs.433168 | 17 6.47E-05 | 16.269 | | S100A3 | S100 calcium binding protein A3 |
| | 205713_s_at | Hs.1584 | 18 0.000452 | 15.658 | | COMP | cartilage oligomeric matrix protein /// cartilage oligomeric matrix protein |
| | 220635_at | Hs.146824 | 21 0.000164 | 9.708 | | PSORS1C2 | psoriasis susceptibility 1 candidate 2 |
| | 207909_x_at | Hs.522868 | 22 0.00415 | 7.917 | | DAZ2 | deleted in azoospermia 4 |
| | 208282_x_at | Hs.70936 | 23 0.00513 | 7.647 | | DAZ2 | deleted in azoospermia 2 |
| | 207912_s_at | Hs.522868 | 24 0.00655 | 7.135 | | DAZ4 | deleted in azoospermia 4 |
| 279 | 213880_at | Hs.166705 | 25 0.0017 | 6.836 | AF062006 | GPR49 | G protein-coupled receptor 49 |
| | 219270_at | Hs.155569 | 26 0.00626 | 6.752 | | MGC4504 | hypothetical protein MGC4504 |
| 280 | 206987_x_at | Hs.87191 | 27 7.63E-05 | 5.950 | AF211188 | FGF18 | fibroblast growth factor 18 |
| | 208281_x_at | Hs.70936 | 28 0.00383 | 5.853 | | DAZ3 | deleted in azoospermia 2 |
| | 207065_at | Hs.145949 | 30 2.49E-06 | 5.822 | | K6HF | cytokeratin type II |
| | 202833_s_at | Hs.297681 | 31 0.00135 | 5.721 | | SERPINA1 | serine (or cysteine) proteinase inhibitor, clade A (alpha-1 antiproteinase, antitrypsin), member 1 |
| | 216351_x_at | Hs.447836 | 32 0.00374 | 5.462 | | DAZ3 | deleted in azoospermia 4 |
| | 216922_x_at | Hs.447836 | 33 0.00577 | 5.320 | | DAZ3 | deleted in azoospermia 4 |
| | 208092_s_at | Hs.4863 | 34 0.000952 | 5.124 | | DKFZp566A1524 | hypothetical protein DKFZp566A1524 /// hypothetical protein DKFZp566A1524 |
| | 213909_at | Hs.288467 | 36 9.59E-05 | 4.542 | | LRRC15 | carboxypeptidase N, polypeptide 2, 83kD |
| | 211485_s_at | Hs.87191 | 37 0.0165 | 4.348 | | FGF18 | fibroblast growth factor 18 |
| | 204667_at | Hs.105460 | 38 0.000165 | 4.206 | | DKFZP564O0823 | DKFZP564O0823 protein |
| | 219932_at | Hs.48765 | 39 0.0014 | 3.982 | | SLC27A6 | solute carrier family 27 (fatty acid transporter), member 6 |
| | 222351_at | Hs.431156 | 40 3.98E-05 | 3.931 | | PPP2R1B | protein phosphatase 2 (formerly 2A), regulatory subunit A (PR 65), beta isoform |
| | 218935_at | Hs.368808 | 41 0.000485 | 3.872 | | EHD3 | EH-domain containing 3 |
| | 203304_at | Hs.348802 | 42 0.000213 | 3.740 | | BAMBI | putative transmembrane protein |
| | 209343_at | Hs.289242 | 44 0.000224 | 3.725 | | EFHD1 | likely ortholog of neuronally expressed calcium binding protein |
| | 220272_at | | 45 0.000253 | 3.634 | | BNC2 | hypothetical protein FLJ20043 |
| | 212915_at | Hs.177635 | 46 0.00175 | 3.512 | | PDZRN3 | likely ortholog of mouse semaF cytoplasmic domain associated protein 3 |
| | 209921_at | Hs.8786 | 48 3.79E-05 | 3.479 | | CHST12 | carbohydrate (N-acetylglucosamine-6-O) sulfotransferase 2 |
| 281 | 205290_s_at | Hs.73853 | 49 0.000335 | 3.479 | AA583044 | BMP2 | bone morphogenetic protein 2 |
| | 202376_at | Hs.76353 | 50 0.00343 | 3.470 | | SERPINA3 | serine (or cysteine) proteinase inhibitor, clade A (alpha-1 antiproteinase, antitrypsin), member 3 |
| | 210393_at | Hs.166705 | 51 0.00165 | 3.341 | | GPR49 | G protein-coupled receptor 49 |
| | 211429_s_at | Hs.513816 | 52 0.00823 | 3.326 | | | Homo sapiens PRO2275 mRNA, complete cds |
| 282 | 206140_at | Hs.1569 | 54 0.00129 | 3.239 | NM_004789 | LHX2 | LIM homeobox 2 |
| | 216604_s_at | Hs.22891 | 55 0.0184 | 3.192 | | SLC7A8 | solute carrier family 7 (cationic amino acid transporter, y+ system), member 8 |
| 283 | 201109_s_at | Hs.164226 | 56 0.00142 | 3.192 | AV726673 | THBS1 | thrombospondin 1 |
| | 204720_s_at | Hs.129587 | 57 0.00678 | 3.187 | | DNAJC6 | DnaJ (Hsp40) homolog, subfamily C, member 6 |
| 284 | 209757_s_at | Hs.25960 | 58 0.00433 | 3.062 | BC002712 | MYCN | v-myc myelocytomatosis viral related oncogene, neuroblastoma derived (avian) |
| | 205374_at | Hs.334629 | 61 0.00195 | 2.945 | | SLN | sarcolipin |
| | 219250_s_at | Hs.41296 | 62 0.000267 | 2.879 | | FLRT3 | fibronectin leucine rich transmembrane protein 3 |
| | 219832_s_at | Hs.118608 | 63 0.00223 | 2.859 | | HOXC13 | homeo box C13 |
| | 209921_at | Hs.6682 | 65 0.000634 | 2.813 | | SLC7A11 | solute carrier family 7 (cationic amino acid transporter, y+ system), member 11 |
| | 211071_s_at | Hs.75823 | 66 0.00162 | 2.791 | | AF1Q | ALL1-fused gene from chromosome 1q /// ALL1-fused gene from chromosome 1q |
| | 216603_at | Hs.22891 | 67 0.00189 | 2.749 | | SLC7A8 | solute carrier family 7 (cationic amino acid transporter, y+ system), member 8 |
| 285 | 216248_s_at | Hs.82120 | 69 0.0553 | 2.711 | S77154 | NR4A2 | nuclear receptor subfamily 4, group A, member 2 |
| | 201110_s_at | Hs.164226 | 70 0.0088 | 2.703 | | THBS1 | thrombospondin 1 |
| 286 | 202016_at | Hs.440459 | 71 0.00104 | 2.645 | NM_002402 | MEST | mesoderm specific transcript homolog (mouse) |
| 287 | 215034_s_at | Hs.351316 | 73 0.00234 | 2.619 | AI189753 | TM4SF1 | transmembrane 4 superfamily member 1 |

Figure 13A.1

| | | | | | | | |
|---|---|---|---|---|---|---|---|
| | 202884_s_at | Hs.431156 | 74 | 0.00128 | 2.591 | | PPP2R1B | protein phosphatase 2 (formerly 2A), regulatory subunit A (PR 65), beta isoform |
| | 204622_x_at | Hs.82120 | 75 | 0.0761 | 2.566 | | NR4A2 | nuclear receptor subfamily 4, group A, member 2 |
| 288 | 206315_at | Hs.114948 | 77 | 0.00217 | 2.559 | NM_004750 | CRLF1 | cytokine receptor-like factor 1 |
| | 209266_at | Hs.352554 | 78 | 0.000419 | 2.550 | | CDC42EP3 | CDC42 effector protein (Rho GTPase binding) 3 |
| | 203980_at | Hs.391561 | 79 | 0.000137 | 2.541 | | FABP4 | fatty acid binding protein 4, adipocyte |
| | 210319_x_at | Hs.89404 | 80 | 0.00247 | 2.531 | | MSX2 | msh homeo box homolog 2 (Drosophila) |
| | 201108_s_at | Hs.164226 | 81 | 0.00529 | 2.514 | | THBS1 | thrombospondin 1 |
| | 204351_at | Hs.2962 | 82 | 0.0011 | 2.495 | | S100P | S100 calcium binding protein P |
| | 212154_at | Hs.1501 | 83 | 0.000882 | 2.492 | | SDC2 | syndecan 2 (heparan sulfate proteoglycan 1, cell surface-associated, fibroglycan) |
| | 212158_at | Hs.1501 | 84 | 0.019923 | 2.488 | | SDC2 | syndecan 2 (heparan sulfate proteoglycan 1, cell surface-associated, fibroglycan) |
| | 202391_at | Hs.511745 | 85 | 0.000112 | 2.482 | | BASP1 | brain abundant, membrane attached signal protein 1 |
| | 205206_at | Hs.380850 | 86 | 0.00629 | 2.433 | | KAL1 | Kallmann syndrome 1 sequence |
| 289 | 218368_s_at | Hs.355899 | 90 | 0.0257 | 2.395 | NM_016639 | TNFRSF12A | tumor necrosis factor receptor superfamily, member 12A |
| | 214036_at | Hs.288741 | 91 | 0.003346 | 2.392 | | | Homo sapiens cDNA: FLJ22256 fis, clone HRC02860 |
| | 209288_s_at | Hs.352554 | 92 | 0.00243 | 2.378 | | CDC42EP3 | CDC42 effector protein (Rho GTPase binding) 3 |
| | 210082_at | Hs.416767 | 93 | 0.0092 | 2.369 | | ABCA4 | ATP-binding cassette, sub-family A (ABC1), member 4 |
| | 213100_at | Hs.13350 | 94 | 0.000421 | 2.367 | | UNC5B | unc-5 homolog B (C. elegans) |
| | 205555_s_at | Hs.89404 | 95 | 0.0221 | 2.363 | | MSX2 | msh homeo box homolog 2 (Drosophila) |
| | 215785_s_at | Hs.211201 | 96 | 2.45E-05 | 2.352 | | CYFIP2 | cytoplasmic FMR1 interacting protein 2 |
| | 200906_s_at | Hs.194431 | 98 | 0.000308 | 2.328 | | KIAA0992 | palladin |
| | 201147_s_at | Hs.245188 | 99 | 0.00591 | 2.327 | | TIMP3 | tissue inhibitor of metalloproteinase 3 (Sorsby fundus dystrophy, pseudoinflammatory) |
| | AFFX-HUMRGE/M10098_M_a | | 100 | 0.265 | 2.307 | | GPR34 | |
| | 205932_s_at | Hs.424414 | 102 | 0.000967 | 2.286 | | MSX1 | msh homeo box homolog 1 (Drosophila) |
| 290 | 214433_s_at | Hs.334841 | 103 | 0.0044 | 2.277 | NM_003944 | SELENBP1 | selenium binding protein 1 |
| | 204621_s_at | Hs.82120 | 104 | 0.0998 | 2.249 | | NR4A2 | nuclear receptor subfamily 4, group A, member 2 |
| | 201149_s_at | Hs.245188 | 105 | 0.00926 | 2.243 | | TIMP3 | tissue inhibitor of metalloproteinase 3 (Sorsby fundus dystrophy, pseudoinflammatory) |
| 291 | 205269_at | Hs.78853 | 106 | 0.000366 | 2.233 | AA583044 | BMP2 | bone morphogenetic protein 2 |
| | 201148_s_at | Hs.245188 | 108 | 0.0187 | 2.204 | | TIMP3 | tissue inhibitor of metalloproteinase 3 (Sorsby fundus dystrophy, pseudoinflammatory) |
| | 216092_s_at | Hs.22891 | 109 | 7.62E-05 | 2.200 | | SLC7A8 | solute carrier family 7 (cationic amino acid transporter, y+ system), member 8 |
| | 210335_at | Hs.159296 | 110 | 0.0297 | 2.199 | | PAMCI | peptidylglycine alpha-amidating monooxygenase COOH-terminal interactor |
| | 210074_at | Hs.87417 | 111 | 0.000872 | 2.195 | | CTSL2 | cathepsin L2 |
| | 209386_at | Hs.351316 | 112 | 0.00415 | 2.191 | | TM4SF1 | transmembrane 4 superfamily member 1 |
| | 213826_at | Hs.447694 | 113 | 0.314 | 2.179 | | | H3 histone, family 3A |
| | 213556_at | Hs.22049 | 114 | 0.00166 | 2.154 | | | Homo sapiens cDNA FLJ26039 fis, clone PRS03963 |
| | 205931_s_at | Hs.149 | 115 | 0.033 | 2.142 | | CREB5 | cAMP responsive element binding protein 5 |
| | 203797_at | Hs.2288 | 117 | 3.68E-05 | 2.134 | | VSNL1 | visinin-like 1 |
| | 204268_at | Hs.413843 | 119 | 0.0147 | 2.120 | | S100A2 | S100 calcium binding protein A2 |
| | 221962_s_at | Hs.372756 | 120 | 0.03361 | 2.107 | | UBE2H | ubiquitin-conjugating enzyme E2H (UBC8 homolog, yeast) |
| | 205724_at | Hs.313068 | 121 | 0.0184 | 2.106 | | PKP1 | plakophilin 1 (ectodermal dysplasia/skin fragility syndrome) |
| | 219229_at | Hs.118657 | 122 | 0.000184 | 2.105 | | SLC03A1 | solute carrier family organic anion transporter family, member 3A1 |
| | 202166_s_at | Hs.267819 | 123 | 6.52E-05 | 2.092 | | PPP1R2 | protein phosphatase 1, regulatory (inhibitor) subunit 2 |
| | 219766_at | Hs.36563 | 126 | 0.0679 | 2.085 | | B7-H4 | immune costimulatory protein B7-H4 |
| | 201287_s_at | Hs.82109 | 127 | 0.00821 | 2.082 | | SDC1 | syndecan 1 |
| | 204256_at | Hs.211556 | 128 | 0.01209 | 2.067 | | ELOVL6 | ELOVL family member 6, elongation of long chain fatty acids (FEN1/Elo2, SUR4/Elo3-like, yeast) |
| | 210868_s_at | Hs.211556 | 129 | 0.0138 | 2.049 | | ELOVL6 | ELOVL family member 6, elongation of long chain fatty acids (FEN1/Elo2, SUR4/Elo3-like, yeast) |
| | 202693_s_at | Hs.9075 | 130 | 0.000351 | 2.043 | | STK17A | serine/threonine kinase 17a (apoptosis-inducing) |
| | 205472_s_at | Hs.63931 | 131 | 0.00153 | 2.029 | | DACH1 | dachshund homolog (Drosophila) |
| | 203798_s_at | Hs.2288 | 132 | 0.00214 | 2.027 | | VSNL1 | visinin-like 1 |
| | 209367_at | Hs.36563 | 133 | 0.01176 | 2.015 | | TM4SF1 | transmembrane 4 superfamily member 1 |
| | 202935_s_at | Hs.2316 | 134 | 0.0152 | 2.011 | | SOX9 | SRY (sex determining region Y)-box 9 (campomelic dysplasia, autosomal sex-reversal) |

Figure 13A.2

| | | | | | |
|---|---|---|---|---|---|
| 202363_at | Hs.93029 | 135 | 0.00147 | 2.007 | SPOCK | sparc/osteonectin, cwcv and kazal-like domains proteoglycan (testican) |
| 205471_s_at | Hs.63931 | 136 | 0.00417 | 2.005 | DACH1 | dachshund homolog (Drosophila) |
| 200730_s_at | | 137 | 0.00346 | 2.002 | PTP4A1 | protein tyrosine phosphatase type IVA, member 1 |
| 204141_at | Hs.512712 | 138 | 4.89E-05 | 1.994 | TUBB | tubulin, beta polypeptide |
| 219295_s_at | Hs.89944 | 139 | 0.0172 | 1.991 | PCOLCE2 | procollagen C-endopeptidase enhancer 2 |
| 202436_s_at | Hs.154654 | 140 | 0.00296 | 1.969 | CYP1B1 | cytochrome P450, family 1, subfamily B, polypeptide 1 |
| 222162_s_at | Hs.8230 | 141 | 0.0357 | 1.968 | ADAMTS1 | a disintegrin-like and metalloprotease (reprolysin type) with thrombospondin type 1 motif, 1 |
| 208637_x_at | Hs.119000 | 142 | 0.00105 | 1.961 | ACTN1 | actinin, alpha 1 |
| 204682_at | Hs.105689 | 143 | 0.00102 | 1.938 | LTBP2 | latent transforming growth factor beta binding protein 2 |
| 205534_at | Hs.443020 | 144 | 0.00631 | 1.936 | PCDH7 | BH-protocadherin (brain-heart) |
| 203574_at | Hs.79334 | 145 | 0.00106 | 1.935 | NFIL3 | nuclear factor, interleukin 3 regulated |
| 209683_at | Hs.4863 | 147 | 0.00635 | 1.931 | DKFZP566A1524 | hypothetical protein DKFZp566A1524 |
| 292 214104_at | Hs.271609 | 155 | 0.00245 | 1.901 AF703188 | GPR161 | G protein-coupled receptor 161 |
| 293 203903_s_at | Hs.31720 | 167 | 0.00629 | 1.842 NM_014799 | HEPH | hephaestin |
| 294 203706_s_at | Hs.173859 | 170 | 0.008 | 1.822 NM_003507 | FZD7 | frizzled homolog 7 (Drosophila) |
| 295 201559_s_at | Hs.25035 | 201 | 0.0123 | 1.713 AF109196 | CLIC4 | chloride intracellular channel 4 |
| 221881_s_at | Hs.25035 | 202 | 0.000518 | 1.713 | CLIC4 | chloride intracellular channel 4 |
| 207826_s_at | Hs.76884 | 203 | 0.0147 | 1.709 | ID3 | inhibitor of DNA binding 3, dominant negative helix-loop-helix protein |
| 205908_s_at | Hs.94070 | 12701 | 0.0532 | 1.932 | OMD | osteomodulin |
| 218162_at | Hs.9315 | 12704 | 0.00983 | -1.972 | OLFML3 | HNOEL-iso protein |
| 213158_at | Hs.161193 | 12705 | 0.179 | -1.975 | | Homo sapiens mRNA; cDNA DKFZp586B211 (from clone DKFZp586B211) |
| 296 209541_at | Hs.308053 | 12708 | 0.0548 | -1.992 AI972496 | IGF1 | insulin-like growth factor 1 (somatomedin C) |
| 202531_at | Hs.806645 | 12712 | 0.0034 | -2.020 | IRF1 | interferon regulatory factor 1 |
| 221651_x_at | | 12713 | 0.214 | -2.022 | IGKC | |
| 297 206637_at | Hs.2465 | 12714 | 0.0277 | -2.029 NM_014879 | GPR105 | G protein-coupled receptor 105 |
| 206023_at | Hs.418367 | 12718 | 0.0295 | -2.046 | NMU | neuromedin U |
| 204870_s_at | Hs.315186 | 12719 | 0.0116 | -2.047 | PCSK2 | proprotein convertase subtilisin/kexin type 2 |
| 209708_at | Hs.5909 | 12720 | 9.80E-05 | -2.052 | MOXD1 | monooxygenase, DBH-like 1 |
| 212588_at | Hs.444324 | 12721 | 0.00236 | -2.055 | PTPRC | protein tyrosine phosphatase, receptor type, C |
| 202450_s_at | Hs.83942 | 12722 | 0.00388 | -2.059 | CTSK | cathepsin K (pycnodysostosis) |
| 213293_s_at | Hs.318501 | 12723 | 0.00187 | -2.062 | TRIM22 | tripartite motif-containing 22 |
| 204198_s_at | Hs.170019 | 12725 | 0.033 | -2.063 | RUNX3 | runt-related transcription factor 3 |
| 203498_at | Hs.156007 | 12726 | 0.116 | -2.076 | DSCR1L1 | Down syndrome critical region gene 1-like 1 |
| 213568_at | Hs.152823 | 12728 | 0.0297 | -2.110 | OSR2 | odd-skipped-related 2A protein |
| 298 205226_at | Hs.170040 | 12730 | 0.0102 | -2.156 NM_006207 | PDGFRL | platelet-derived growth factor receptor-like |
| 203649_s_at | Hs.76422 | 12733 | 0.0669 | -2.166 | PLA2G2A | phospholipase A2, group IIA (platelets, synovial fluid) |
| 203915_at | Hs.77367 | 12734 | 0.151 | -2.184 | CXCL9 | chemokine (C-X-C motif) ligand 9 |
| 215446_s_at | | 12736 | 0.004 | -2.193 | | |
| 204279_at | Hs.381081 | 12737 | 0.027 | -2.219 | PSMB9 | proteasome (prosome, macropain) subunit, beta type, 9 (large multifunctional protease 2) |
| 205433_at | Hs.422857 | 12738 | 0.0154 | -2.245 | BCHE | butyrylcholinesterase |
| 213068_at | Hs.80552 | 12740 | 0.0202 | -2.263 | DPT | dermatopontin |
| 299 209699_at | Hs.249159 | 12742 | 0.0403 | -2.285 AF284095 | ADRA2A | adrenergic, alpha-2A-, receptor |
| 213975_s_at | | 12743 | 0.000432 | -2.291 | LYZ | lysozyme (renal amyloidosis) |
| 300 209924_at | Hs.16530 | 12744 | 0.0946 | -2.293 AB000221 | CCL18 | chemokine (C-C motif) ligand 18 (pulmonary and activation-regulated) |
| 201069_at | Hs.367877 | 12745 | 0.00183 | -2.317 | MMP2 | matrix metalloproteinase 2 (gelatinase A, 72kDa gelatinase, 72kDa type IV collagenase) |
| 202411_at | Hs.278613 | 12746 | 0.0619 | -2.319 | IFI27 | interferon, alpha-inducible protein 27 |
| 217521_at | Hs.190783 | 12747 | 0.00611 | -2.325 | HAL | histidine ammonia-lyase |
| 217767_at | Hs.284394 | 12749 | 0.00563 | -2.348 | C3 | complement component 3 |
| 204160_s_at | Hs.54037 | 12752 | 0.0183 | -2.471 | ENPP4 | ectonucleotide pyrophosphatase/phosphodiesterase 4 (putative function) |

Figure 13A.3

| | | | | | |
|---|---|---|---|---|---|
| 203001_s_at | Hs.90005 | 12753 | 0.0142 | -2.508 | STMN2 | stathmin-like 2 |
| 205083_at | Hs.406238 | 12755 | 0.00409 | -2.523 | AOX1 | aldehyde oxidase 1 |
| 214536_at | Hs.103505 | 12756 | 0.00338 | -2.597 | ARS | ARS component B |
| 212224_at | Hs.76392 | 12757 | 0.00171 | -2.609 | ALDH1A1 | aldehyde dehydrogenase 1 family, member A1 |
| 203000_at | | 12758 | 0.0125 | -2.614 | STMN2 | stathmin-like 2 |
| 211161_s_at | | 12759 | 0.00944 | -2.686 | | |
| 210195_s_at | Hs.1787 | 12760 | 0.00628 | -2.704 | PLP1 | proteolipid protein 1 (Pelizaeus-Merzbacher disease, spastic paraplegia 2, uncomplicated) |
| 206227_at | Hs.442180 | 12762 | 0.0317 | -2.911 | CILP | cartilage intermediate layer protein, nucleotide pyrophosphohydrolase |
| 301 210072_at | Hs.50002 | 12763 | 0.00378 | -2.920 U85321 | CCL19 | chemokine (C-C motif) ligand 19 |
| 202768_at | Hs.75678 | 12764 | 0.000436 | -3.172 | FOSB | FBJ murine osteosarcoma viral oncogene homolog B |
| 209189_at | Hs.25647 | 12765 | 0.0218 | -3.183 | FOS | v-fos FBJ murine osteosarcoma viral oncogene homolog |
| 211663_x_at | | 12766 | 0.00998 | -3.337 | PTGDS | prostaglandin D2 synthase 21kDa (brain) /// prostaglandin D2 synthase 21kDa (brain) |
| 211748_x_at | Hs.446429 | 12769 | 0.00383 | -3.900 | PTGDS | prostaglandin D2 synthase 21kDa (brain) /// prostaglandin D2 synthase 21kDa (brain) |
| 215121_x_at | Hs.356861 | 12771 | 0.0294 | -4.116 | | Homo sapiens cDNA FLJ26905 fis, clone RCT01427, highly similar to Ig lambda chain C regions |
| 302 212187_x_at | Hs.446429 | 12772 | 0.00326 | -4.230 M61900 | PTGDS | prostaglandin D2 synthase 21kDa (brain) |
| 303 220356_at | Hs.340634 | 12774 | 0.00973 | -4.676 NM_006587 | CORIN | corin |

Figure 13A.4

| SEQ ID No: | Systematic | UniGene | GO biological process | GO cellular component |
|---|---|---|---|---|
| 277 | 221297_at | Hs.283073 | visual perception | membrane |
| 278 | 206423_at | Hs.146559 | response to oxidative stress | cytoplasm; soluble fraction |
| | 207457_s_at | Hs.408316 | | |
| | 206027_at | Hs.433168 | | |
| | 205713_s_at | Hs.1584 | cell adhesion; skeletal development | extracellular matrix |
| | 220635_at | Hs.146824 | biological process unknown | cellular component unknown |
| | 207909_x_at | Hs.522868 | fertilization (sensu Animalia); spermatogenesis | nucleus |
| | 208282_x_at | Hs.70936 | | |
| | 207912_s_at | Hs.522868 | fertilization (sensu Animalia); spermatogenesis | nucleus |
| 279 | 213880_at | Hs.166705 | | |
| | 219270_at | Hs.155569 | | |
| 280 | 206987_x_at | Hs.87191 | cell-cell signaling; morphogenesis; positive regulation of cell proliferation; signal transduction | extracellular space |
| | 208281_x_at | Hs.70936 | | |
| | 207065_at | Hs.145949 | acute-phase response | intermediate filament |
| | 202833_s_at | Hs.297681 | spermatogenesis | nucleus |
| | 216351_x_at | Hs.447836 | fertilization (sensu Animalia); spermatogenesis | nucleus |
| | 216922_x_at | Hs.447836 | | |
| | 208092_s_at | Hs.4863 | | |
| | 213909_at | Hs.288467 | | |
| | 211485_s_at | Hs.87191 | cell-cell signaling; morphogenesis; positive regulation of cell proliferation; signal transduction | extracellular space |
| | 204687_at | Hs.105460 | | |
| | 219932_at | Hs.49765 | metabolism; very-long-chain fatty acid metabolism | |
| | 222351_at | Hs.431156 | | |
| | 218935_at | Hs.369808 | | nucleus |
| | 203304_at | Hs.348802 | | integral to membrane |
| | 209343_at | Hs.289242 | | |
| | 220272_at | | | |
| | 212915_at | Hs.177635 | | |
| | 203921_at | Hs.8786 | | |
| 281 | 205290_s_at | Hs.73853 | cell growth and/or maintenance; cell-cell signaling; skeletal development | extracellular |
| | 202376_at | Hs.76353 | | |
| | 210393_at | Hs.166705 | G-protein coupled receptor protein signaling pathway | integral to plasma membrane |
| | 211429_s_at | Hs.513816 | | |
| 282 | 206140_at | Hs.1569 | regulation of transcription, DNA-dependent | nucleus |
| | 216604_s_at | Hs.22891 | | |
| 283 | 201109_s_at | Hs.164226 | | |
| | 204720_s_at | Hs.129587 | | |
| 284 | 209757_s_at | Hs.25960 | cell growth and/or maintenance; regulation of transcription of transcription from Pol II promoter | chromatin; nucleus |
| | 205374_at | Hs.334629 | transport | integral to membrane; sarcoplasmic reticulum; smooth endoplasmic reticulum |
| | 219250_s_at | Hs.41296 | cell adhesion | extracellular matrix; integral to plasma membrane |
| | 219832_s_at | Hs.118608 | morphogenesis; regulation of transcription, DNA-dependent | nucleus |
| | 209921_at | Hs.6682 | amino acid transport; protein complex assembly | integral to membrane |
| | 211071_s_at | Hs.75823 | cell growth and/or maintenance | cellular component unknown |
| | 216603_at | Hs.22891 | | |
| 285 | 216248_s_at | Hs.82120 | antimicrobial humoral response (sensu Vertebrata); regulation of transcription, DNA-dependent; signal transduction | nucleus |
| | 201110_s_at | Hs.164226 | blood coagulation; cell adhesion; cell motility; development; neurogenesis | extracellular matrix; extracellular space |
| 286 | 202016_at | Hs.440459 | response to toxin; xenobiotic metabolism | |
| 287 | 215034_s_at | Hs.351316 | | |

Figure 13B.1

| | | | |
|---|---|---|---|
| | 203884_s_at | Hs.431156 | RNA splicing; ceramide metabolism; inactivation of MAPK; induction of apoptosis; negative regulation of cell growth; negative regulation of tyrosine phosphorylation of Stat3 protein; protein amino acid dephosphorylation; protein complex assembly; regulation of DNA replication; regulation of Wnt receptor signaling pathway; regulation of cell adhesion; regulation or cell cycle; regulation of cell differentiation; regulation of growth; regulation of transcription; regulation of translation; response to organic substance; second messenger-mediated signaling | cytosol; membrane; microtubule cytoskeleton; mitochondrion; nucleus; protein phosphatase type 2A complex; soluble fraction |
| | 204622_x_at | Hs.82120 | antimicrobial humoral response (sensu Vertebrata); regulation of transcription, DNA-dependent; signal transduction | nucleus |
| 288 | 205315_at | Hs.114948 | | |
| | 209286_at | Hs.352554 | | |
| | 203980_at | Hs.391561 | | |
| | 210319_x_at | Hs.89404 | development; regulation of transcription, DNA-dependent; skeletal development | nucleus |
| | 201108_s_at | Hs.164226 | | |
| | 204351_at | Hs.2962 | | |
| | 212154_at | Hs.1501 | | |
| | 212158_at | Hs.1501 | | |
| | 202391_at | Hs.511745 | axon guidance; cell adhesion; cell motility; chemotaxis | cytoskeleton; plasma membrane |
| | 205206_at | Hs.360850 | angiogenesis; apoptosis; cell adhesion; cell motility; development | extracellular matrix; extracellular space |
| 289 | 218368_s_at | Hs.355899 | | integral to membrane |
| | 214036_at | Hs.288741 | signal transduction | |
| | 209288_s_at | Hs.352554 | | |
| | 201147_s_at | Hs.416707 | | |
| | 213100_at | Hs.133503 | development; regulation of transcription, DNA-dependent; skeletal development | nucleus |
| | 205555_s_at | Hs.89404 | immune response | extracellular |
| | 215785_s_at | Hs.211201 | | |
| | 209906_at | Hs.194431 | | |
| | 201148_s_at | Hs.245188 | | |
| | AFFX-HUMRGE/M10098_M_at | | | |
| | 205932_s_at | Hs.424414 | development; regulation of transcription, DNA-dependent; skeletal development | nucleus |
| 290 | 214433_s_at | Hs.334841 | | |
| | 204621_s_at | Hs.82120 | | |
| | 201149_s_at | Hs.245188 | induction of apoptosis by extracellular signals; visual perception | extracellular matrix |
| 291 | 205289_at | Hs.73853 | | |
| | 201148_s_at | Hs.245188 | | |
| | 216092_s_at | Hs.22891 | | |
| | 210335_at | Hs.159396 | endosome transport; neuropeptide signaling pathway; protein targeting | cytosol; endosome; perinuclear space; trans-Golgi network transport vesicle membrane |
| | 210074_at | Hs.87417 | proteolysis and peptidolysis | lysosome |
| | 209386_at | Hs.351316 | | |
| | 213826_s_at | Hs.447694 | | |
| | 213556_at | Hs.22049 | | |
| | 205931_s_at | Hs.149 | positive regulation of transcription, DNA-dependent; transcription from Pol II promoter | nucleus |
| | 203797_at | Hs.2298 | | |
| | 204268_at | Hs.413843 | biological_process unknown | cellular_component unknown |
| | 221962_s_at | Hs.372758 | | |
| | 205724_at | Hs.313068 | cell adhesion; signal transduction | cytoskeleton; desmosome; nucleus |
| | 219229_at | Hs.113657 | ion transport | integral to membrane |
| | 202166_s_at | Hs.267819 | | |
| | 219768_at | Hs.36563 | | |
| | 201287_s_at | Hs.82109 | | integral to plasma membrane |
| | 204256_at | Hs.211556 | | integral to membrane |
| | 210868_s_at | Hs.211556 | | integral to membrane |

Figure 13B.2

| | | | |
|---|---|---|---|
| 202693_s_at | Hs.9075 | | |
| 205472_s_at | Hs.63931 | cell growth and/or maintenance; development; regulation of transcription, DNA-dependent | nucleus |
| 203798_s_at | Hs.2288 | | |
| 209387_s_at | | biological_process unknown | integral to plasma membrane |
| 202935_s_at | Hs.2316 | | |
| 202363_at | Hs.93029 | cell adhesion; cell motility; cell proliferation; development; neurogenesis | extracellular matrix; extracellular space |
| 205471_s_at | Hs.63931 | | |
| 200730_s_at | | | |
| 204141_at | Hs.512712 | | |
| 219295_s_at | Hs.8944 | | |
| 202436_s_at | Hs.154654 | | |
| 222162_s_at | Hs.8230 | integrin-mediated signaling pathway; negative regulation of cell proliferation; proteolysis and peptidolysis | extracellular matrix |
| 209637_x_at | Hs.119000 | | actin cytoskeleton |
| 204682_at | Hs.105689 | extracellular transport; protein secretion; protein targeting; regulation of cell cycle; transforming growth factor beta receptor signaling pathway | extracellular matrix; extracellular space |
| 205534_at | Hs.443020 | cell adhesion; homophilic cell adhesion | integral to plasma membrane |
| 203574_at | Hs.79334 | immune response; regulation of transcription, DNA-dependent; transcription from Pol II promoter | nucleus |
| 209683_at | Hs.4863 | | |
| 292 214104_at | Hs.271809 | | |
| 293 203903_s_at | Hs.31720 | | |
| 294 203706_s_at | Hs.173859 | G-protein coupled receptor protein signaling pathway; cell surface receptor linked signal transduction; development; frizzled signaling pathway | integral to membrane; plasma membrane |
| 295 201559_s_at | Hs.25035 | chloride transport; ion transport | membrane |
| 221881_s_at | | | |
| 207826_s_at | Hs.76864 | development | nucleus |
| 205908_s_at | Hs.94070 | cell adhesion | extracellular matrix |
| 218162_at | Hs.93315 | | |
| 213158_at | Hs.16193 | | |
| 296 209541_at | Hs.308053 | | |
| 202531_at | Hs.80645 | immune response; negative regulation of cell cycle; regulation of transcription, DNA-dependent; transcription from Pol II promoter | nucleus |
| 221651_x_at | Hs.2465 | G-protein coupled receptor protein signaling pathway | integral to membrane |
| 297 206637_at | Hs.418367 | digestion; neuropeptide signaling pathway; regulation of smooth muscle contraction; signal transduction | |
| 206023_at | Hs.315186 | cell-cell signaling; proteolysis and peptidolysis | Golgi apparatus; extracellular space |
| 204870_s_at | Hs.6909 | catecholamine metabolism | |
| 209708_at | Hs.444324 | cell surface receptor linked signal transduction; protein amino acid dephosphorylation | integral to plasma membrane |
| 212588_at | Hs.893942 | | |
| 202450_s_at | Hs.318501 | | |
| 213293_s_at | Hs.170019 | | |
| 204198_s_at | Hs.156007 | calcium-mediated signaling; central nervous system development | cellular_component unknown |
| 203498_at | Hs.152823 | | |
| 213568_at | Hs.170040 | | |
| 298 205226_at | Hs.76422 | lipid catabolism | extracellular; membrane |
| 203649_s_at | Hs.77367 | G-protein coupled receptor protein signaling pathway; cell-cell signaling; cellular defense response; chemotaxis; inflammatory response; signal transduction | extracellular space |
| 203915_at | | | |
| 215446_s_at | | | |
| 204279_at | Hs.381061 | immune response; proteolysis and peptidolysis; ubiquitin-dependent protein catabolism | proteasome core complex (sensu Eukarya) |

Figure 13B.3

| | | | | |
|---|---|---|---|---|
| | 205433_at | Hs.422857 | cocaine metabolism | |
| | 213066_at | Hs.800552 | | |
| 299 | 209869_at | Hs.2491159 | G-protein coupled receptor protein signaling pathway; RAS protein signal transduction; Rho protein signal transduction; actin cytoskeleton organization and biogenesis; activation of MAPK; cell motility; negative regulation of adenylate cyclase activity; positive regulation of cell proliferation | integral to plasma membrane |
| | 213975_s_at | | | |
| 300 | 209924_at | Hs.16530 | antimicrobial humoral response (sensu Vertebrata); cell-cell signaling; chemotaxis; immune response; inflammatory response; response to biotic stimulus; signal transduction | extracellular |
| | 201069_at | Hs.367877 | collagen catabolism | extracellular matrix; extracellular space |
| | 202411_at | Hs.278613 | immune response | integral to membrane |
| | 217521_at | Hs.190783 | | |
| | 217767_at | Hs.284394 | | |
| | 204160_s_at | Hs.54037 | | |
| | 203001_s_at | Hs.90005 | | |
| | 205083_at | Hs.406238 | electron transport; inflammatory response, oxygen and reactive oxygen species metabolism | extracellular |
| | 214536_at | Hs.103505 | biological_process unknown | |
| | 212224_at | Hs.76392 | | |
| | 203000_at | | | |
| | 211161_s_at | | | |
| | 210195_s_at | Hs.17787 | | |
| | 206227_at | Hs.442180 | nucleobase, nucleoside, nucleotide and nucleic acid metabolism | extracellular |
| 301 | 210072_at | Hs.50092 | calcium ion homeostasis; chemotaxis; immune response; inflammatory response; response to virus; signal transduction | extracellular |
| | 202768_at | Hs.75678 | behavior; development; negative regulation of transcription from Pol II promoter; regulation of cell cycle; regulation of transcription, DNA dependent | nucleus |
| | 209189_at | Hs.25647 | DNA methylation; cell growth and/or maintenance; inflammatory response; regulation of transcription from Pol II promoter | nucleus |
| | 211663_x_at | | prostaglandin biosynthesis; regulation of circadian sleep/wake cycle, sleep; transport | Golgi apparatus; extracellular; membrane; nuclear membrane; rough endoplasmic reticulum |
| | 211748_x_at | Hs.446429 | prostaglandin biosynthesis; regulation of circadian sleep/wake cycle, sleep; transport | Golgi apparatus; extracellular; membrane; nuclear membrane; rough endoplasmic reticulum |
| | 215121_x_at | Hs.356861 | | |
| 302 | 212187_x_at | Hs.446429 | prostaglandin biosynthesis; regulation of circadian sleep/wake cycle, sleep; transport | Golgi apparatus; extracellular; membrane; nuclear membrane; rough endoplasmic reticulum |
| 303 | 220356_at | Hs.340834 | lipid metabolism; morphogenesis; proteolysis and peptidolysis; regulation of blood pressure | integral to plasma membrane |

Figure 13B.4

METHODS AND COMPOSITIONS FOR INHIBITING OR REDUCING HAIR LOSS, ACNE, ROSACEA, PROSTATE CANCER, AND BPH

CROSS-REFERENCE TO RELATED APPLICATIONS

This application is a divisional application of U.S. patent application Ser. No. 12/303,998 is a National Phase Application of PCT International Application No. PCT/US07/14031, International Filing Date Jun. 15, 2007, claiming priority of U.S. Provisional Patent Application 60/814,041, filed Jun. 16, 2006 and 60/845,161, filed Sep. 18, 2006, all which are incorporated herein by reference in their entirety.

FIELD OF INVENTION

This invention provides methods of treating androgenetic alopecia (AGA), acne, rosacea, prostate cancer, and benign prostatic hypertrophy (BPH), comprising the step of contacting a subject with a compound or composition capable of decreasing prostaglandin D2 (PGD2) level or activity, a downstream signaling or receptor pathway thereof, or prostaglandin D2 synthase level or activity; methods of stimulating hair growth, comprising the step of contacting a subject with a compound or composition capable of increasing or decreasing the activity or level of a target gene of the present invention, or with a protein product of the target gene or an analogue or mimetic thereof; and methods of testing for AGA and evaluating therapeutic methods thereof, comprising measuring PGD2 levels.

BACKGROUND OF THE INVENTION

In normal scalp, hair follicles (HF) constantly cycle between a growing stage (anagen), an involutional stage (catagen), and then a dormant stage (telogen). The length of the hair is determined by the duration of anagen. Thus, scalp follicles stay in anagen for 2-7 years, while non-scalp follicles typically remain in anagen for much shorter times. The caliber of the hair shaft and the cycling of the follicle are thought to be under control of the dermal papilla, a cluster of inductive mesenchymal-derived cells located at the base of the follicle. Anagen onset appears to be triggered by mesenchymal-epithelial interactions between the dermal papilla cells and nearby hair follicle stem cells in the bulge, which is located at or near the insertion of the arrector pili muscle. Bulge cell progeny generate the new lower anagen hair follicle at anagen onset and contribute cells to the epidermis after wounding.

Androgenetic alopecia (AGA) remains enigmatic. Often, AGA is characterized by conversion of large "terminal" follicles into "miniaturized" follicles that resemble the vellus follicles of the prepubescent face. AGA often results in an increase in the proportion of hair follicles in telogen at the expense of follicles in anagen. Often, mild fibrosis replaces follicles in long-standing alopecia. Hypotheses to explain AGA include hormonal, genetic, and inflammatory insults.

SUMMARY OF THE INVENTION

This invention provides methods of treating androgenetic alopecia (AGA), acne, rosacea, prostate cancer, and benign prostatic hypertrophy (BPH), comprising the step of contacting a subject with a compound or composition capable of decreasing prostaglandin D2 (PGD2) level or activity, a downstream signaling or receptor pathway thereof, or prostaglandin D2 synthase level or activity; methods of stimulating hair growth, comprising the step of contacting a subject with a compound or composition capable of increasing or decreasing the activity or level of a target gene of the present invention, or with a protein product of the target gene or an analogue or mimetic thereof; and methods of testing for AGA and evaluating therapeutic methods thereof, comprising measuring PGD2 levels.

In one embodiment, the present invention provides a method of treating baldness in a scalp of a subject, comprising the step of contacting the subject with a compound or composition capable of inhibiting a prostaglandin D2 activity, thereby treating baldness in a scalp of a subject. In another embodiment, the baldness is caused by an AGA. In another embodiment the compound or composition inhibits the prostaglandin D2 activity in the target scalp. Each possibility represents a separate embodiment of the present invention.

In another embodiment, the present invention provides a method of treating baldness in a scalp of a subject, comprising the step of contacting the subject with a compound or composition capable of inhibiting a signaling or receptor pathway downstream of prostaglandin D2, thereby treating baldness in a scalp of a subject. In another embodiment, the baldness is caused by an AGA. In another embodiment, the compound or composition inhibits the signaling pathway in the target scalp. Each possibility represents a separate embodiment of the present invention.

In another embodiment, the present invention provides a method of treating baldness in a scalp of a subject, comprising the step of contacting the subject with a compound or composition capable of decreasing a level of a prostaglandin D2, thereby treating baldness in a scalp of a subject. In another embodiment, the baldness is caused by an AGA. In another embodiment, the compound or composition decreases the prostaglandin D2 level in the target scalp. Each possibility represents a separate embodiment of the present invention.

In another embodiment, the present invention provides a method of treating baldness in a scalp of a subject, comprising the step of contacting the subject with a compound or composition capable of inhibiting an activity of a prostaglandin D2 synthase enzyme, thereby treating baldness in a scalp of a subject. In another embodiment, the baldness is caused by an AGA. In another embodiment, the compound or composition inhibits the prostaglandin D2 synthase activity in the target scalp. Each possibility represents a separate embodiment of the present invention.

In another embodiment, the present invention provides a method of treating baldness in a scalp of a subject, comprising the step of contacting the subject with a compound or composition capable of decreasing a level of a prostaglandin D2 synthase enzyme, thereby treating baldness in a scalp of a subject. In another embodiment, the baldness is caused by an AGA. In another embodiment, the compound or composition decreases the prostaglandin D2 synthase level in the target scalp. Each possibility represents a separate embodiment of the present invention.

In another embodiment, the present invention provides a method of stimulating a hair growth in a subject, comprising the step of contacting the subject with a compound or composition capable of increasing an activity of a target gene of the present invention, thereby stimulating a hair growth in a subject. In another embodiment, the gene is selected from FGF18, GPRC5D, GPR49, LRRC15, Serpin A, and CDT6. In another embodiment, the gene is selected from BMP2, LHX2, THBS1, MYCN, NR4A2, MEST, TM4SF1, CRLF1, TNFRSF12A, SELENBP1, GPR161, HEPH, FZD7, and CLIC4. In another embodiment, the compound or composition increases the target gene activity in the target scalp or skin. Each possibility represents a separate embodiment of the present invention.

In another embodiment, the present invention provides a method of stimulating a hair growth in a subject, comprising the step of contacting the subject with a compound or composition capable of increasing an expression of a target gene of the present invention, thereby stimulating a hair growth in a subject. In another embodiment, the gene is selected from FGF18, GPRC5D, GPR49, LRRC15, Serpin A, and CDT6. In another embodiment, the gene is selected from BMP2, LHX2, THBS1, MYCN, NR4A2, MEST, TM4SF1, CRLF1, TNFRSF12A, SELENBP1, GPR161, HEPH, FZD7, and CLIC4. In another embodiment, the compound or composition increases the target gene expression in the target scalp or skin. In another embodiment, the compound or composition increases the level of a protein encoded by the target gene in the target scalp or skin. Each possibility represents a separate embodiment of the present invention.

In another embodiment, the present invention provides a method of stimulating a hair growth in a subject, comprising the step of contacting the subject with a recombinant protein product of a target gene of the present invention, thereby stimulating a hair growth in a subject. In another embodiment, a mimetic or analogue of the protein product is administered. In another embodiment, the compound or composition increases the protein product concentration in the target scalp or skin. In another embodiment, the protein product is FGF18. In another embodiment, the protein product is a product of any target gene selected from GPRC5D, GPR49, LRRC15, Serpin A, and CDT6. In another embodiment, the gene is selected from BMP2, LHX2, THBS1, MYCN, NR4A2, MEST, TM4SF1, CRLF1, TNFRSF12A, SELENBP1, GPR161, HEPH, FZD7, and CLIC4. In another embodiment, the protein product is a product of any target gene of the present invention. Each possibility represents a separate embodiment of the present invention.

In another embodiment, the present invention provides a method of stimulating a hair growth in a subject, comprising the step of contacting the subject with a compound or composition capable of decreasing an activity of a target gene of the present invention, thereby stimulating a hair growth in a subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, PTGD2, and CORIN. In another embodiment, the compound or composition decreases the target gene activity in the target scalp or skin. Each possibility represents a separate embodiment of the present invention.

In another embodiment, the present invention provides a method of stimulating a hair growth in a subject, comprising the step of contacting the subject with a compound or composition capable of decreasing an expression of a target gene of the present invention, thereby stimulating a hair growth in a subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, PTGD2, and CORIN. In another embodiment, the compound or composition decreases the target gene expression in the target scalp or skin. In another embodiment, the compound or composition decreases the level of a protein encoded by the target gene in the target scalp or skin. Each possibility represents a separate embodiment of the present invention.

In another embodiment, the present invention provides a method of testing a subject for a presence of an AGA, comprising the steps of: (a) measuring a level of a prostaglandin D2 (PGD2) in the scalp of the subject; and (b) comparing the level to a reference standard, wherein, if the level is appreciably elevated relative to the reference standard, then the subject has AGA.

In another embodiment, the present invention provides a method of testing a subject for a presence of an AGA, comprising the steps of: (a) measuring a level of a PGD2 metabolite in the scalp of the subject; and (b) comparing the level to a reference standard, wherein, if the level is appreciably elevated relative to the reference standard, then the subject has AGA.

In another embodiment, the present invention provides a method of testing a subject for a presence of an AGA, comprising the steps of: (a) measuring a level of a PGD2 in a body fluid of the subject; and (b) comparing the level to a reference standard, wherein, if the level is appreciably elevated relative to the reference standard, then the subject has AGA.

In another embodiment, the present invention provides a method of testing a subject for a presence of an AGA, comprising the steps of: (a) measuring a level of a PGD2 metabolite in a body fluid of the subject; and (b) comparing the level to a reference standard, wherein, if the level is appreciably elevated relative to the reference standard, then the subject has AGA.

In another embodiment, the present invention provides a method of testing an efficacy of baldness therapy in a subject, comprising the steps of: (a) measuring a first level of a PGD2 in the scalp of the subject, and (b) administering the baldness therapy to the subject; and (c) measuring a second level of the PGD2 in the scalp, wherein, if the second level is significantly decreased relative to the first level, then the baldness therapy is efficacious.

In another embodiment, the present invention provides a method of testing an efficacy of baldness therapy in a subject, comprising the steps of: (a) measuring a first level of a PGD2 metabolite in the scalp of the subject, and (b) administering the baldness therapy to the subject; and (c) measuring a second level of the PGD2 in the scalp, wherein, if the second level is significantly decreased relative to the first level, then the baldness therapy is efficacious.

In another embodiment, the present invention provides a method of testing an efficacy of baldness therapy in a subject, comprising the steps of: (a) measuring a first level of a PGD2 in a body fluid of the subject, and (b) administering the baldness therapy to the subject; and (c) measuring a second level of the PGD2 in the body fluid, wherein, if the second level is significantly decreased relative to the first level, then the baldness therapy is efficacious.

In another embodiment, the present invention provides a method of testing an efficacy of baldness therapy in a subject, comprising the steps of: (a) measuring a first level of a PGD2 metabolite in a body fluid of the subject, and (b) administering the baldness therapy to the subject; and (c) measuring a second level of the PGD2 in the body fluid, wherein, if the second level is significantly decreased relative to the first level, then the baldness therapy is efficacious.

In another embodiment, the present invention provides a method of testing an efficacy of baldness therapy in a subject, comprising the steps of: (a) measuring a first level of a PGD2 or a metabolite thereof in a body fluid of the subject, and (b) administering the baldness therapy to the subject; and (c) measuring a second level of the PGD2 or metabolite thereof in the body fluid, wherein, if the second level is appreciably decreased relative to the first level, then the baldness therapy is efficacious.

In another embodiment, the present invention provides a method of stimulating a hair growth in a subject, the method comprising the steps of (a) isolating an alpha-6 integrin$^{high}$ CD200$^{high}$ cell population from a haired area of the subject; and (b) contacting a bald or hair-deficient region of the subject with the alpha-6 integrin$^{high}$ CD200$^{high}$ cell population, thereby stimulating a hair growth in a subject.

In another embodiment, the present invention provides a method of stimulating a hair growth in a subject, comprising the step of contacting the subject with a compound or composition capable of increasing a level of a CD200 protein, thereby stimulating a hair growth in a subject.

In another embodiment, the present invention provides a method of stimulating a hair growth in a subject, comprising the step of contacting the subject with a recombinant CD200 protein, thereby stimulating a hair growth in a subject. In another embodiment, a mimetic or analogue of a CD200 protein is administered. Each possibility represents a separate embodiment of the present invention.

In another embodiment, the present invention provides a method of stimulating a hair growth in a subject, comprising the step of contacting the subject with a compound or composition capable of decreasing an activity of a CD200 protein, thereby stimulating a hair growth in a subject.

In another embodiment, the present invention provides a method of treating acne in a skin of a subject, comprising the step of contacting the subject with a compound or composition that inhibits a prostaglandin D2 activity in the skin, thereby treating acne in a skin of a subject.

In another embodiment, the present invention provides a method of treating acne in a skin of a subject, comprising the step of contacting the subject with a compound or composition that inhibits a signaling or receptor pathway downstream of a prostaglandin D2 in the skin, thereby treating acne in a skin of a subject.

In another embodiment, the present invention provides a method of treating acne in a skin of a subject, comprising the step of contacting the subject with a compound or composition that decreases a level of a prostaglandin D2 in the skin, thereby treating acne in a skin of a subject.

In another embodiment, the present invention provides a method of treating acne in a skin of a subject, comprising the step of contacting the subject with a compound or composition that inhibits an activity of a PGD2S enzyme in the skin, thereby treating acne in a skin of a subject.

In another embodiment, the present invention provides a method of treating acne in a skin of a subject, comprising the step of contacting the subject with a compound or composition that decreases a level of a prostaglandin D2 synthase enzyme in the skin, thereby treating acne in a skin of a subject.

In another embodiment, the present invention provides a method of treating rosacea in a skin of a subject, comprising the step of contacting the subject with a compound or composition that inhibits a prostaglandin D2 activity in the skin, thereby treating rosacea in a skin of a subject.

In another embodiment, the present invention provides a method of treating rosacea in a skin of a subject, comprising the step of contacting the subject with a compound or composition that inhibits a signaling or receptor pathway downstream of a prostaglandin D2 in the skin, thereby treating rosacea in a skin of a subject.

In another embodiment, the present invention provides a method of treating rosacea in a skin of a subject, comprising the step of contacting the subject with a compound or composition that decreases a level of a prostaglandin D2 in the skin, thereby treating rosacea in a skin of a subject.

In another embodiment, the present invention provides a method of treating rosacea in a skin of a subject, comprising the step of contacting the subject with a compound or composition that inhibits an activity of a PGD2S enzyme in the skin, thereby treating rosacea in a skin of a subject.

In another embodiment, the present invention provides a method of treating rosacea in a skin of a subject, comprising the step of contacting the subject with a compound or composition that decreases a level of a prostaglandin D2 synthase enzyme in the skin, thereby treating rosacea in a skin of a subject.

In another embodiment, the present invention provides a method of treating rosacea in a skin of a subject, comprising the step of contacting the subject with a compound or composition that decreases a level of a prostaglandin D2 synthase enzyme in the skin, thereby treating rosacea in a skin of a subject.

In another embodiment, the present invention provides a method of treating prostate cancer or BPH in a subject, comprising the step of contacting the subject with a compound or composition that inhibits a prostaglandin D2 activity in the prostate gland, thereby treating prostate cancer or BPH in a subject.

In another embodiment, the present invention provides a method of treating prostate cancer or BPH in a subject, comprising the step of contacting the subject with a compound or composition that inhibits a signaling or receptor pathway downstream of a prostaglandin D2 in the prostate gland, thereby treating prostate cancer or BPH in a subject.

In another embodiment, the present invention provides a method of treating prostate cancer or BPH in a subject, comprising the step of contacting the subject with a compound or composition that decreases a level of a prostaglandin D2 in the prostate gland, thereby treating prostate cancer or BPH in a subject.

In another embodiment, the present invention provides a method of treating prostate cancer or BPH in a subject, comprising the step of contacting the subject with a compound or composition that inhibits an activity of a PGD2S enzyme in the prostate gland, thereby treating prostate cancer or BPH in a subject.

In another embodiment, the present invention provides a method of predicting the development of AGA in a subject, comprising the step of measuring an amount of PGD2 in the skin or scalp of the subject. In another embodiment, an amount of a PGD2 metabolite is measured. Each possibility represents a separate embodiment of the present invention.

In another embodiment, the present invention provides a pharmaceutical composition, comprising a COX-2 inhibitor and an inhibitor of prostaglandin D2 activity. In another embodiment, the pharmaceutical composition further comprises a pro-hair growth prostaglandin. In another embodiment, the pro-hair growth prostaglandin is a prostaglandin E1. In another embodiment, the pro-hair growth prostaglandin is a prostaglandin E2. In another embodiment, the pro-hair growth prostaglandin is a prostaglandin F2a. In another embodiment, the pro-hair growth prostaglandin is any other pro-hair growth prostaglandin known in the art. Each possibility represents a separate embodiment of the present invention.

In another embodiment, the present invention provides a pharmaceutical composition, comprising a COX-2 inhibitor and an downregulator of prostaglandin D2 levels. In another embodiment, the pharmaceutical composition further comprises a pro-hair growth prostaglandin. In another embodiment, the pro-hair growth prostaglandin is a prostaglandin E1. In another embodiment, the pro-hair growth prostaglandin is a prostaglandin E2. In another embodiment, the pro-hair growth prostaglandin is a prostaglandin F2a. In another embodiment, the pro-hair growth prostaglandin is any other pro-hair growth prostaglandin known in the art. Each possibility represents a separate embodiment of the present invention.

In another embodiment, the present invention provides a pharmaceutical composition, comprising a COX-2 inhibitor and a pro-hair growth prostaglandin. In another embodiment, the pro-hair growth prostaglandin is a prostaglandin E1. In another embodiment, the pro-hair growth prostaglandin is a prostaglandin E2. In another embodiment, the pro-hair growth prostaglandin is a prostaglandin F2a. In another embodiment, the pro-hair growth prostaglandin is any other pro-hair growth prostaglandin known in the art. Each possibility represents a separate embodiment of the present invention.

In another embodiment, the present invention provides a pharmaceutical composition, comprising an inhibitor of prostaglandin D2 activity and a pro-hair growth prostaglandin. In another embodiment, the pro-hair growth prostaglandin is a prostaglandin E1. In another embodiment, the pro-hair growth prostaglandin is a prostaglandin E2. In another embodiment, the pro-hair growth prostaglandin is a prostaglandin F2a. In another embodiment, the pro-hair growth prostaglandin is any other pro-hair growth prostaglandin known in the art. Each possibility represents a separate embodiment of the present invention.

BRIEF DESCRIPTION OF THE FIGURES

FIG. 2A-D—FACS analysis of keratinocyte isolated from scalp indicates stem cell numbers are similar in paired bald and haired scalp samples, but suprabasal cell numbers are decreased within the stem cell compartment of bald scalp. FIG. 2A) Lack of staining from isotype antibodies, yet virtually complete staining with an anti-actin antibody as a control for permeabilization. Histogram with numbers of cells plotted as a percentage on the y axis, and intensity of staining on the x axis. FIG. 2B) KRT15 and FST co-localize. Pseudo-color plot of KRT15 staining intensity vs. FST staining intensity. Each point represents a cell counted, and the intensity of color is an indication of higher numbers of cells. FIG. 2C) Similar proportion of KRT15$^+$/alpha-6 integrin$^+$ cells in bald and haired scalp. Bald scalp cells (red in the original; middle panels) were overlayed onto haired cells (blue in the original; left panels), as shown in the overlay, which has bald cells in the foreground and haired cells in the background (right panels). Although the red bald cells mostly eclipsed blue haired cells, a conspicuously higher number of blue cells were evident in the stem cell positive alpha-6 integrin$^-$ quadrant (lower right; see FIG. 2E-H). Insets: Percentages of each population. FIG. 2H) FST$^+$ alpha-6 integrin$^+$ compartments in haired and bald scalp. Pseudo-color plots (left and middle panel) and overlay (right panel) were prepared as in (FIG. 2G).

FIG. 2E-H. Grayscale version of FIG. 2A-D. Red appears as gray, and blue appears a black. FIG. 2I-J. Image showing the blue color only from the right panels of FIG. 2C-FIG. 2D.

FIGS. 3A-E. 251 genes with altered expression in bald vs. haired scalp, ranked by statistical significance. FIG. 3A.1-FIG. 3A.13. Overview. FIG. 3B.1-FIG. 3B.7. Raw data. FIG. 3C.1-FIG. 3C.8. Additional information regarding the transcripts. FIG. 3D.1-FIG. 3D.15. Additional information and reference numbers from other databases. FIG. 3E.1-FIG. 3E.23. More information about transcripts. Sequences were from genome version July 2003 (NCBI 34).

FIG. 5. Specific gene expression changes in haired vs. bald scalp of selected genes. A) AR, 3beta-hydroxysteroid dehydrogenase (3beta-HSD), and immune-related genes were significantly up-regulated in bald scalp. Genes enriched in the haired scalp were assigned positive values and calculated as haired/bald; genes enriched in the bald scalp were given negative values and calculated as bald/haired. Fold changes for probe sets corresponding to genes and p values as determined by 3-way ANOVA are listed. B) Additional genes not previously identified in human HF and shown herein to be upregulated in haired scalp.

FIG. 7. FIG. 7A. Microarray analysis reveals statistically significant elevation of L-PGDS type in bald scalp compared to haired scalp of men with male pattern baldness. Each of 3 probe sets, all specific to the L-PGDS mRNA, shows an elevation of at least 3-fold (see Experimental Details Section, Example 1).

FIG. 8. Primers used to generate in situ probes shown in FIG. 6.

FIGS. 9A-F. Haired scalp contains a population of CD200$^{high}$ alpha-6 integrin$^{high}$ cells that are lacking in bald scalp. FIG. 9A. Original figure. FIG. 9B. Figure converted to grayscale. Blue appears as black, and red appears as gray.

FIG. 10.

FIG. 11A. Hair follicle phenotype of normal and K14-COX2 mice. FIG. 11B. L-PGDS staining in anagen dermal papilla. Wild type adult mice were stained with antibodies against L-PGDS (red in original color figure) and DAPI (nuclei; blue in original color figure). The Red center in hair follicle is dermal papillae. FIG. 11C. Figure from FIG. 11B, with red fluorescence only depicted. FIG. 11D. Blue fluorescence only depicted.

FIGS. 13A-B. Additional genes enriched in haired and bald scalp. FIG. 13A.1-FIG. 13A.4. Overview. FIG. 13B.1-FIG. 13B.4. Additional information. "Unigene" refers to UniGene annotation for the Affymetrix chip.

DETAILED DESCRIPTION OF THE INVENTION

Figure 1:
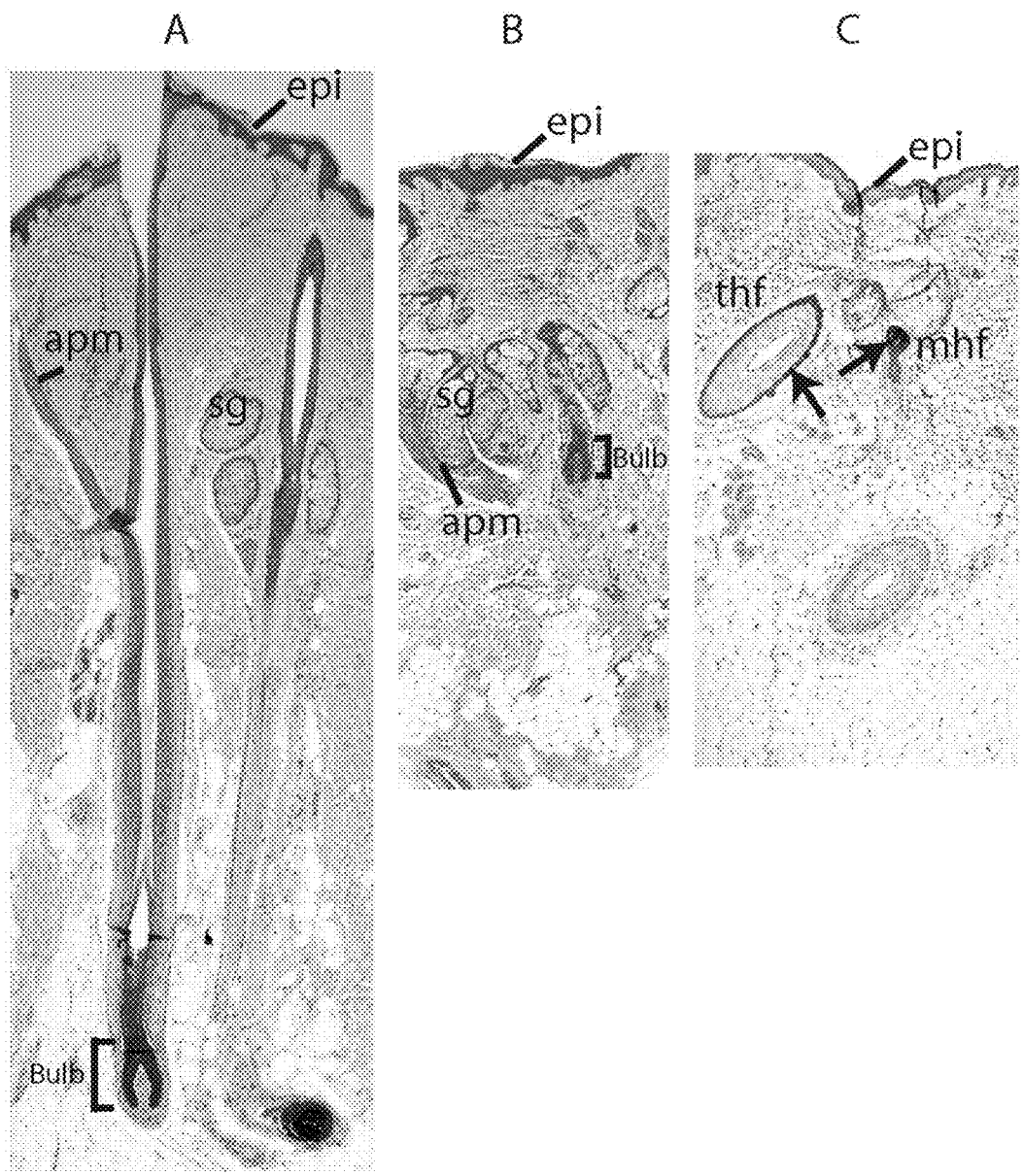
FIG. 1: A. Histology of AGA and Immunohistology of KRT15 in bald scalp. Hematoxylin and eosin stained tissue sections of haired (A) and bald (B) scalp photographed at same magnification exhibit large terminal hair follicle and miniaturized follicle. Note anagen follicle extending to subcutaneous fat in A and only to level of arrector pili muscle (apm) in B. (C) Immunohistology of sections of terminal hair follicle (thf) and miniaturized hair follicle (mhf), both staining for the bulge stem cell marker KRT15 (brown stain, arrows), indicating presence of stem cell compartment in bald scalp. Staining in superficial epidermis (epi) is non-specific. sg, sebaceous gland. (D-E). Scanning electron microscopy of showing hair follicle miniaturization in AGA (E) compared to haired scalp (D).

This invention provides methods of treating androgenetic alopecia (AGA), acne, rosacea, prostate cancer, and benign prostatic hypertrophy (BPH), comprising the step of contacting a subject with a compound or composition capable of decreasing prostaglandin D2 (PGD2) level or activity, a downstream signaling or receptor pathway thereof, or prostaglandin D2 synthase level or activity; methods of stimulating hair growth, comprising the step of contacting a subject with a compound or composition capable of increasing or decreasing the activity or level of a target gene of the present invention, or with a protein product of the target gene or an analogue or mimetic thereof; and methods of testing for AGA and evaluating therapeutic methods thereof, comprising measuring PGD2 levels.

In one embodiment, the present invention provides a method of treating baldness in a scalp of a subject, comprising the step of contacting the subject or the scalp thereof with a compound or composition capable of inhibiting a prostaglandin D2 activity, thereby treating baldness in a scalp of a subject. In another embodiment, the baldness is mediated by an AGA. In another embodiment the compound or composition inhibits the prostaglandin D2 activity in the target scalp. Each possibility represents a separate embodiment of the present invention.

The AGA that is treated by a method of the present invention is, in another embodiment, a male-pattern baldness. In another embodiment, the AGA is a female-pattern baldness. In another embodiment, the AGA is any In another embodiment, the prostaglandin D2 activity is a stimulation of a CRTH2 receptor.

In another embodiment, the present invention provides a method of treating baldness in a scalp of a subject, comprising the step of contacting the scalp with a compound or composition capable of inhibiting a signaling or receptor pathway downstream of prostaglandin D2, thereby treating baldness in a scalp of a subject. In another embodiment, the baldness is mediated by an AGA. In another embodiment, the compound or composition inhibits the signaling pathway in the target scalp.

As provided herein, prostaglandin D2 activity is enriched in bald scalp. In another embodiment, decreasing prostaglandin D2 activity or levels inhibits a mechanism underlying baldness. As provided herein, prostaglandin D2 activity is enriched in bald scalp. In another embodiment, decreasing prostaglandin D2 activity or levels reverses a mechanism underlying baldness. Prostaglandin D2 levels can be decreased, in another embodiment, by inhibiting one of the synthetic pathways leading to its production. Each possibility represents a separate embodiment of the present invention.

"Scalp" in another embodiment, refers to the skin of the top of the head. In another embodiment, the term further includes the underlying connective tissue. In another embodiment, the term further includes the aponeurosis (galea aponeurotica). In another embodiment, the term further includes the underlying loose connective tissue. In another embodiment, the term further includes the pericranium (periosteum). In another embodiment, the term further includes the hair shaft. Each possibility represents a separate embodiment of the present invention.

In another embodiment, a fluid derived from the scalp is utilized in a method of the present invention. In another embodiment, a fluid derived from the scalp known in the art is utilized. In another embodiment, the fluid is obtained using fine needle aspiration. In another embodiment, any other suitable method known in the art is utilized. In another embodiment, a hair shaft is utilized. Each possibility represents a separate embodiment of the present invention.

The signaling pathway that is inhibited in a method of the present invention is, in another embodiment, an adenosine A2a pathway. In another embodiment, the signaling pathway is any other signaling pathway known in the art.

In another embodiment, the signaling pathway is a prostaglandin J2 (PGJ2) pathway. In another embodiment, the pathway is mediated by a metabolite of PGJ2. The PGJ2 metabolite is, in another embodiment, any PGJ2 metabolite known in the art. In another embodiment, the signaling pathway is a prostaglandin F2 (PGF2) pathway. In another embodiment, the signaling pathway is a prostaglandin F2-alpha pathway. In another embodiment, the pathway is mediated by a metabolite of PGF2. In another embodiment, the pathway is mediated by a metabolite of PGF2-alpha. The PGF2 metabolite is, in another embodiment, any PGF2 metabolite known in the art. In another embodiment, the signaling pathway is a 15-deoxy-delta12,14-PGJ2-mediated pathway. In another embodiment, the signaling pathway is a delta12-PGJ2-mediated pathway. In another embodiment, the signaling pathway is a 9alpha,11beta-PGF2-mediated pathway. In another embodiment, the signaling pathway is a 9 alpha,11 beta-2,3-dinor-PGF2-mediated pathway. In another embodiment, the signaling pathway is a pro stacyclin-mediated pathway. In another embodiment, the signaling pathway modulates activity of a peroxisome proliferator-activated receptor (PPAR) transcription factor. In another embodiment, the PPAR is a PPAR gamma-1. In another embodiment, the PPAR is a PPAR gamma-2. In another embodiment, the PPAR is a PPAR delta. In another embodiment, the PPAR is any other PPAR known in the art. Each possibility represents a separate embodiment of the present invention.

In another embodiment, the PGJ2 pathway is mediated by COMP (catechol-O-methyltransferase). In another embodiment, the PGJ2 pathway is mediated by a proteasome (prosome, macropain) 26S subunit (a.k.a. PSMD1). In another embodiment, the PGJ2 pathway is mediated by a SQSTM1 (sequestosome 1). Each possibility represents another embodiment of the present invention.

In another embodiment, the PGF2 pathway is mediated by a PGF2 receptor. In another embodiment, the PGF2 receptor is prostaglandin F receptor (FP) (a.k.a. PTGFR). Each possibility represents another embodiment of the present invention.

In another embodiment, the target of a method or composition of the present invention is a prostaglandin E receptor 2 (subtype EP2) (a.k.a. PTGER2) enzyme. In another embodiment, the target is a prostaglandin E receptor 1 (subtype EP1) (a.k.a. PTGER1) enzyme. Each possibility represents another embodiment of the present invention.

In another embodiment, the signaling pathway is mediated by a prostaglandin (PG) D receptor (DP receptor). In another embodiment, the signaling pathway is mediated by a DP-1 receptor. In another embodiment, the signaling pathway is mediated by a CRTH2 (chemoattractant receptor-homologous molecule expressed on Th2 cells)/DP2 receptor. In another embodiment, the signaling pathway is mediated by a non-canonical signal transduction mediator.

In another embodiment, the signaling pathway includes a DP receptor. In another embodiment, the signaling pathway includes a DP-1 receptor. In another embodiment, the signaling pathway includes a CRTH2/DP2 receptor. In another embodiment, the signaling pathway includes a non-canonical signal transduction mediator.

In another embodiment, the signaling pathway is a DP receptor pathway. In another embodiment, the signaling pathway is a DP-1 receptor pathway. In another embodiment, the signaling pathway is a CRTH2/DP2 receptor pathway. In another embodiment, the signaling pathway is a non-canonical signal transduction mediator pathway.

In another embodiment, the signaling pathway inhibited by methods and compositions of the present invention is any other signaling pathway mediated by a PGD2 receptor. In another embodiment, the signaling pathway any other signaling pathway mediated by a receptor for a PGD2 metabolite. In another embodiment, the signaling pathway is any other signaling or receptor pathway downstream of a PGD2 receptor. In another embodiment, the signaling pathway any other signaling or receptor pathway downstream of a receptor for a PGD2 metabolite. In another embodiment, the receptor is a non-canonical receptor.

Each signaling pathway represents a separate embodiment of the present invention.

The adenosine A2a pathway antagonist utilized in the present invention is, in another embodiment, KF17837.

In another embodiment, the adenosine A2a pathway antagonist is (−)-(11S,2'R)-.alpha.-piperidinyl-2,8-bis(trifluoromethyl)-4-quinolinemethanol. In another embodiment, the adenosine A2a pathway antagonist is (+)-(11R,2'S)-.alpha.-piperidinyl-2,8-bis(trifluoromethyl)-4-quinolinemethanol.

In another embodiment, the adenosine A2a pathway antagonist has one of the formulas:

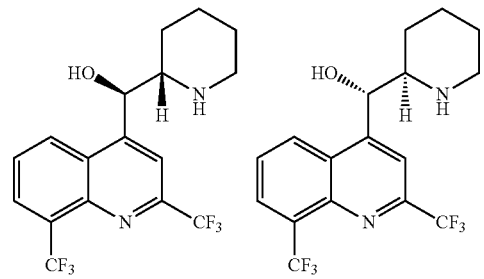 [SMILES: O[C@H](c1cc(C(F)(F)F)nc2c(C(F)(F)F)cccc12)[C@@H]1CCCCN1 ; O[C@@H](c1cc(C(F)(F)F)nc2c(C(F)(F)F)cccc12)[C@H]1CCCCN1]

In another embodiment, the adenosine A2a pathway antagonist has the formula:

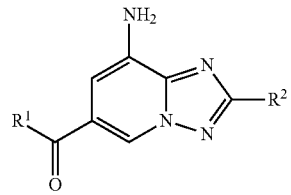

wherein:
R$^1$ is —NR'R",
wherein R' and R" are independently selected from the group consisting of:
lower alkyl, —(CH$_2$)$_n$—C(O)NR$^a$R$^b$, —(CH$_2$)$_n$-heteroaryl, —(CH$_2$)$_n$-aryl, —(CH$_2$)$_n$—CN, —(CH$_2$)$_n$—O-lower alkyl or —(CH$_2$)$_n$-cycloalkyl, or
and R' and R" form together with the N-atom a five or six-membered non-aromatic ring, containing no or one additional heteroatom selected from the group O and S, said ring being unsubstituted or substituted by one or two substituents, selected from the group consisting of lower alkyl, —C(O)NR$^a$R$^b$ or —(CH$_2$)$_n$—O-lower alkyl; and
R$^a$R$^b$ are independently from each other hydrogen or lower alkyl;
R$^2$ is aryl or heteroaryl, unsubstituted or substituted by lower alkyl or halogen; and
n is 0, 1, 2 or 3.

In another embodiment, the adenosine A2a pathway antagonist is [8-Amino-2-(5-bromo-furan-2-yl)-[1,2,4]triazolo[1,5-a]pyridin-6-yl]-piperidin-1-yl-methanone. In another embodiment, the adenosine A2a pathway antagonist is [8-amino-2-(5-bromo-furan-2-yl)-[1,2,4]triazolo[1,5-a]pyridin-6-yl]--pyrrolidin-1-yl-methanone. In another embodiment, the adenosine A2a pathway antagonist is [8-amino-2-(5-bromo-furan-2-yl)-[1,2,4]triazolo[1,5-a]pyridin-6-yl]--(2-methyl-pyrrolidin-1-yl)-methanone. In another embodiment, the adenosine A2a pathway antagonist is 1-[8-amino-2-(5-bromo-furan-2-yl)-[1,2,4]triazolo[1,5-a]pyridine-6-carbonyl]-piperidine-3-carboxylic acid diethylamide. In another embodiment, the adenosine A2a pathway antagonist is [8-amino-2-(5-bromo-furan-2-yl)-[1,2,4]triazolo[1,5-a]pyridin-6-yl]-(3,5-dimethyl-piperidin-1-yl)-methanone. In another embodiment, the adenosine A2a pathway antagonist is [8-amino-2-(5-bromo-furan-2-yl)-[1,2,4]triazolo[1,5-a]pyridin-6-yl]-(2-methyl-piperidin-1-yl)-methanone. In another embodiment, the adenosine A2a pathway antagonist is [8-amino-2-(5-bromo-furan-2-yl)-[1,2,4]triazolo[1,5-a]pyridin-6-yl]-(2-methoxymethyl-pyrrolidin-1-yl)-methanone. In another embodiment, the adenosine A2a pathway antagonist is [8-amino-2-(5-bromo-furan-2-yl)-[1,2,4]triazolo[1,5-a]pyridin-6-yl]-((S)-2-methoxymethyl-pyrrolidin-1-yl)-methanone. In another embodiment, the adenosine A2a pathway antagonist is 1-[8-amino-2-(5-bromo-furan-2-yl)-[1,2,4]triazolo[1,5-a]pyridine-6-carbonyl]-pyrrolidine-2-carboxylic acid (S)-dimethylamide. In another embodiment, the adenosine A2a pathway antagonist is 8-amino-2-(5-bromo-furan-2-yl)-[1,2,4]triazolo[1,5-a]pyridine-6-carboxylic acid dimethylcarbamoylmethyl-methyl-amide. In another embodiment, the adenosine A2a pathway antagonist is [8-amino-2-(5-bromo-furan-2-yl)-[1,2,4]triazolo[1,5-a]pyridin-6-yl]- -(3-methyl-piperidin-1-yl)-methanone. In another embodiment, the adenosine A2a pathway antagonist is 8-amino-2-(5-bromo-furan-2-yl)-[1,2,4]triazolo[1,5-a]pyridine-6-carboxylic acid methyl-propyl-amide. In another embodiment, the adenosine A2a pathway antagonist is 8-amino-2-(5-bromo-furan-2-yl)-[1,2,4]triazolo[1,5-a]pyridine-6-carboxylic acid ethyl-(2-pyridin-2-yl-ethyl)-amide. In another embodiment, the adenosine A2a pathway antagonist is [8-amino-2-(5-bromo-furan-2-yl)-[1,2,4]triazolo[1,5-a]pyridin-6-yl]-thiomorpholin-4-yl-methanone. In another embodiment, the adenosine A2a pathway antagonist is 8-amino-2-(5-bromo-furan-2-yl)-[1,2,4]triazolo[1,5-a]pyridine-6-carboxylic acid methyl-phenethyl-amide.

In another embodiment, the adenosine A2a pathway antagonist is (8-Amino-2-furan-2-yl-[1,2,4]triazolo[1,5-a]pyridin-6-yl)-pyrrolidin-1-yl-methanone. In another embodiment, the adenosine A2a pathway antagonist is (8-amino-2-furan-2-yl-[1,2,4]triazolo[1,5-a]pyridin-6-yl)-(2-R-methoxymethyl-pyrrolidin-1-yl)-methanone. In another embodiment, the adenosine A2a pathway antagonist is (8-amino-2-furan-2-yl-[1,2,4]triazolo[1,5-a]pyridin-6-yl)-(2-S-methoxymethyl-pyrrolidin-1-yl)-methanone. In another embodiment, the adenosine A2a pathway antagonist is 8-amino-2-furan-2-yl-[1,2,4]triazolo[1,5-a]pyridine-6-carboxylic acid dibenzylamide.

In another embodiment, the adenosine A2a pathway antagonist is 8-Amino-2-thiophen-2-yl-[1,2,4]triazolo[1,5-a]-pyridine-6-carboxylic acid dibenzylamide.

In another embodiment, the adenosine A2a pathway antagonist is [8-Amino-2-(5-methyl-furan-2-yl)-[1,2,4]triazolo[1,5-a]pyridin-6-yl]-pyrrolidin-1-yl-methanone. In another embodiment, the adenosine A2a pathway antagonist is [8-amino-2-(5-methyl-furan-2-yl)-[1,2,4]triazolo[1,5-a]pyridin-6-yl]-piperidin-1-yl-methanone. In another embodiment, the adenosine A2a pathway antagonist is [8-amino-2-(5-methyl-furan-2-yl)-[1,2,4]triazolo[1,5-a]pyridin-6-yl]-(2-methyl-pyrrolidin-1-yl)-methanone. In another embodiment, the adenosine A2a pathway antagonist is 8-amino-2-(5-methyl-furan-2-yl)-[1,2,4]triazolo[1,5-a]pyridine-6-carboxylic acid methyl-propylamide.

In another embodiment, the adenosine A2a pathway antagonist has one of the formulas:

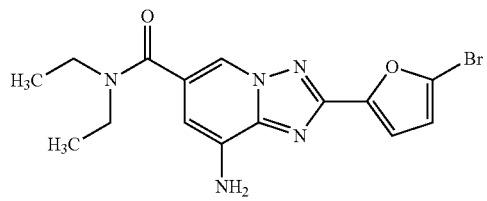

In another embodiment, the adenosine A2a pathway antagonist has one of the formulas:

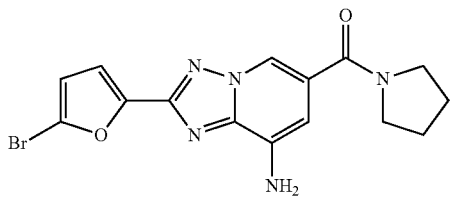

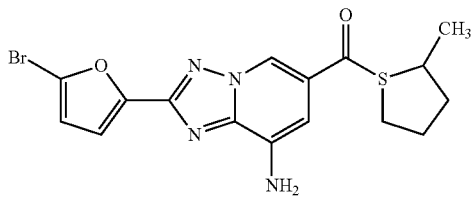

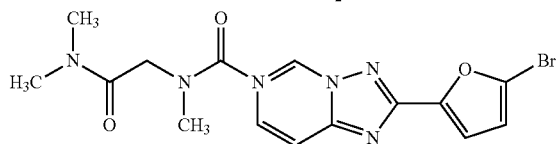

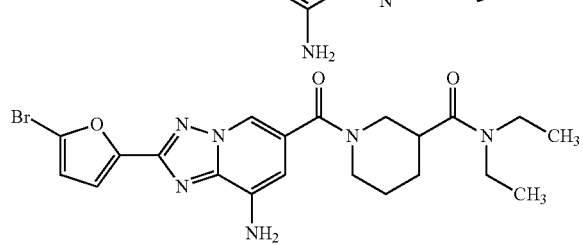

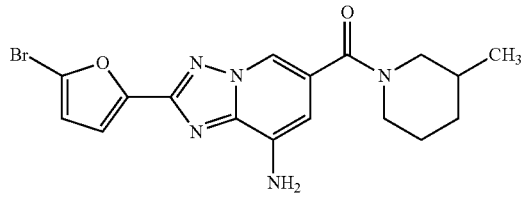

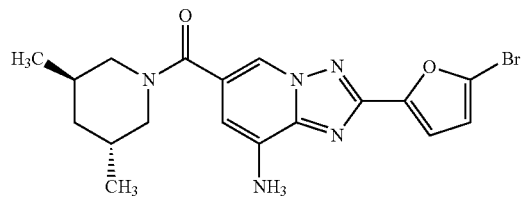

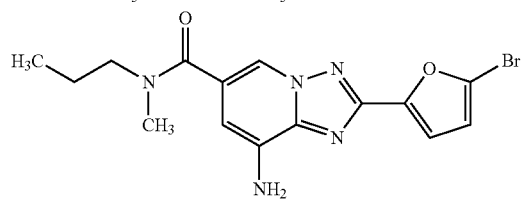

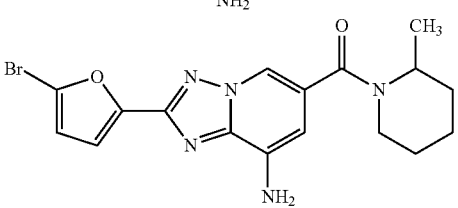

-continued
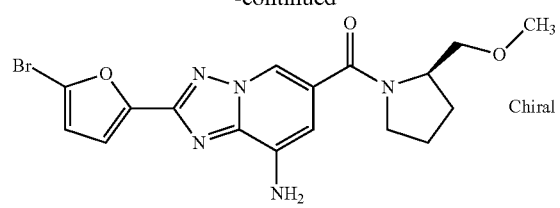
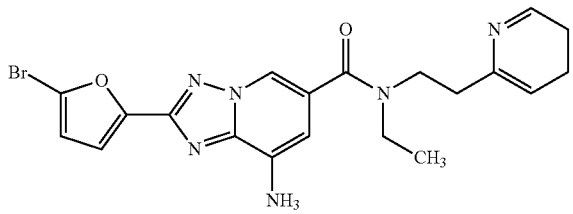
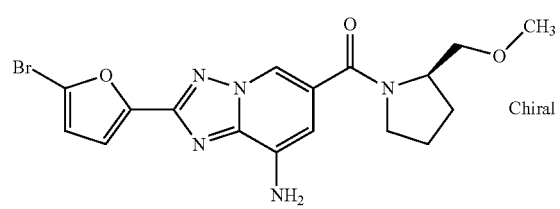
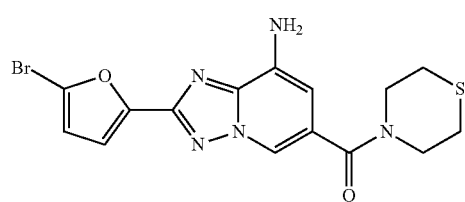
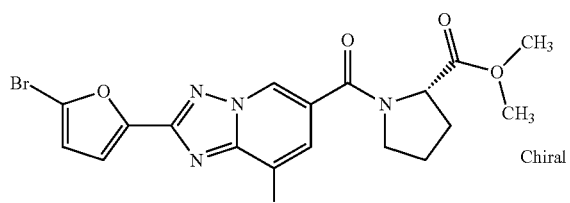
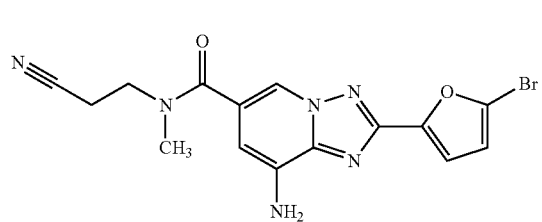
In another embodiment, the adenosine A2a pathway antagonist has one of the formulas:
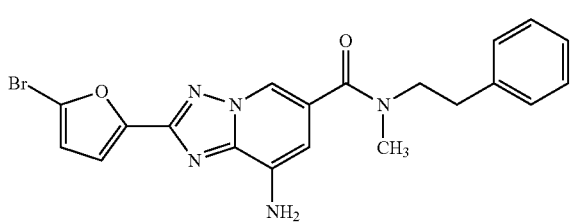
-continued
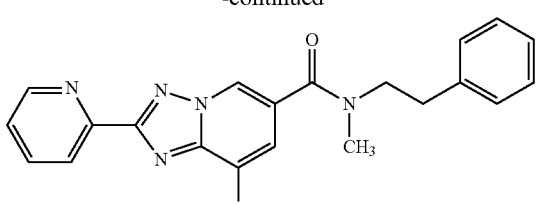
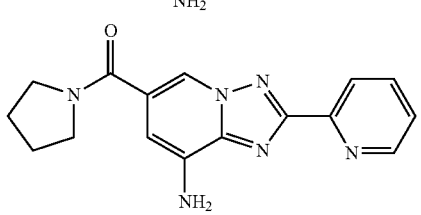
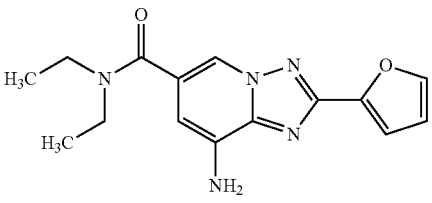
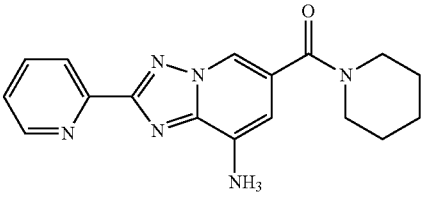
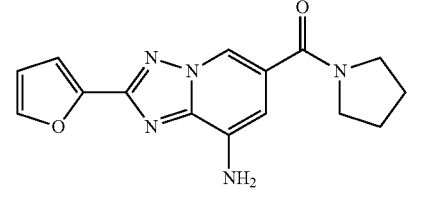
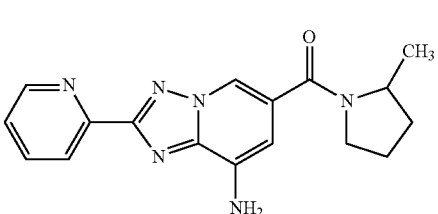
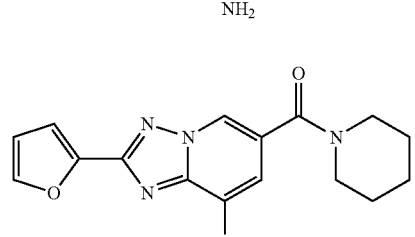
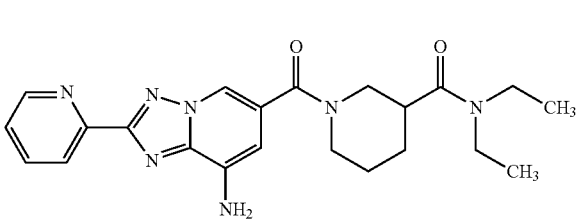

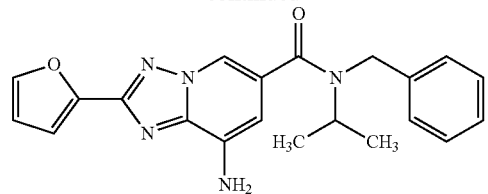
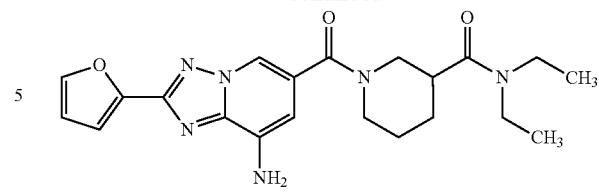
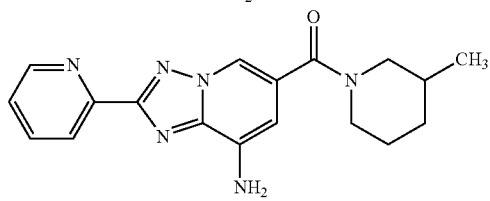
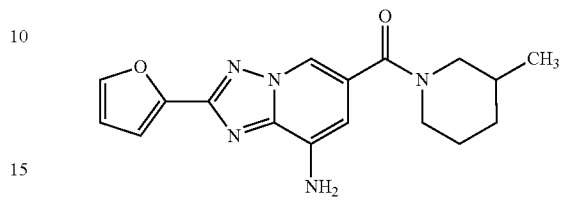
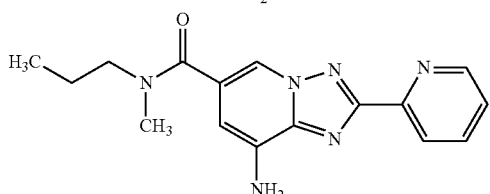
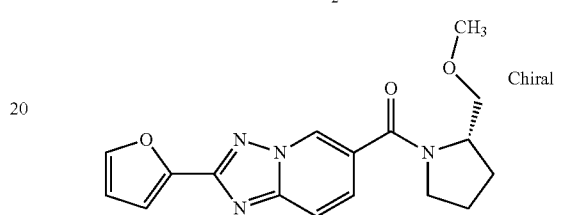
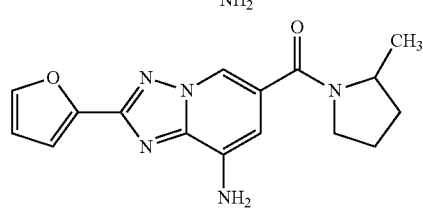
In another embodiment, the adenosine A2a pathway antagonist has one of the formulas:
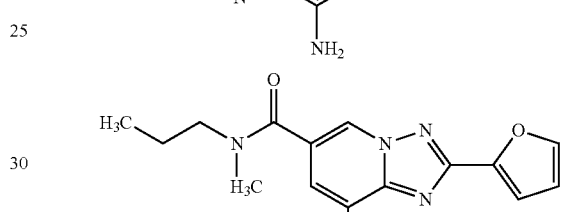
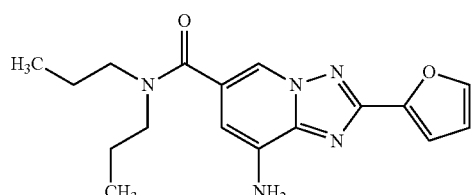
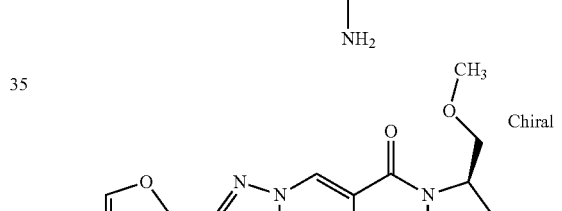
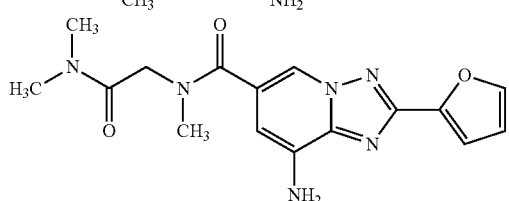
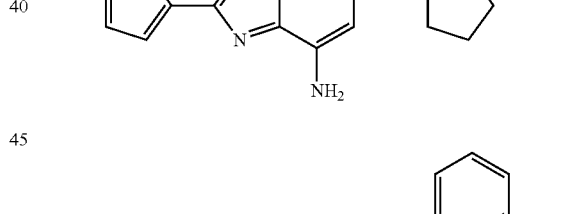
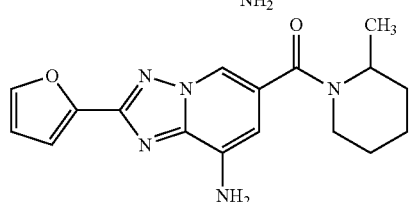
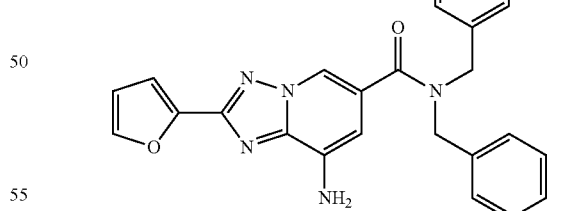
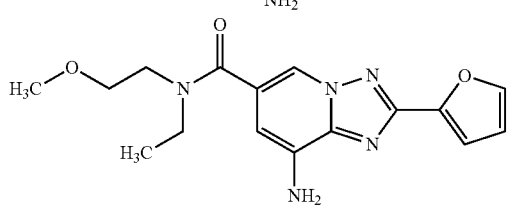
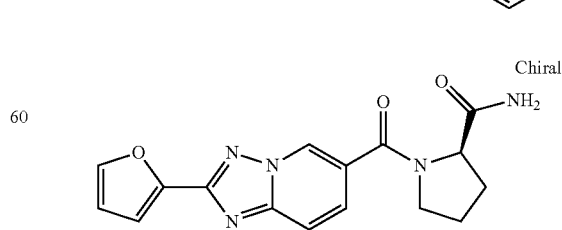

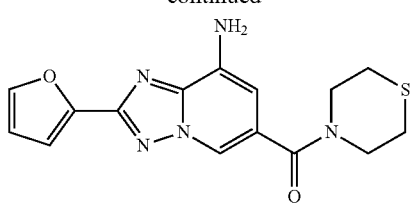
In another embodiment, the adenosine A2a pathway antagonist has one of the formulas:
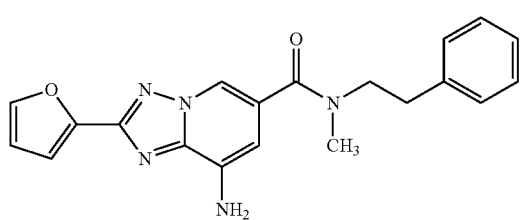
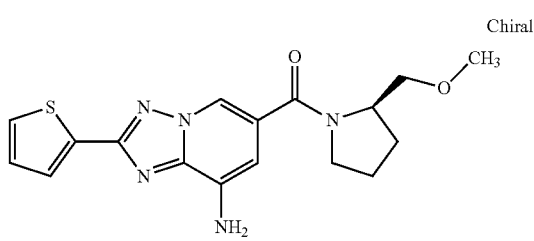
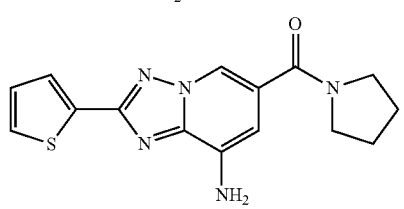
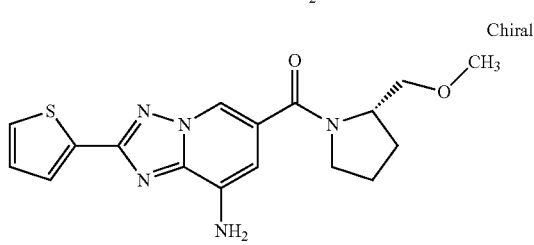
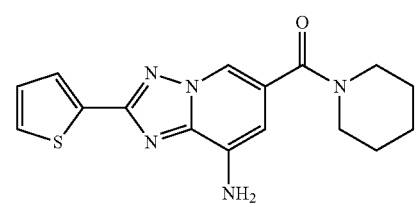
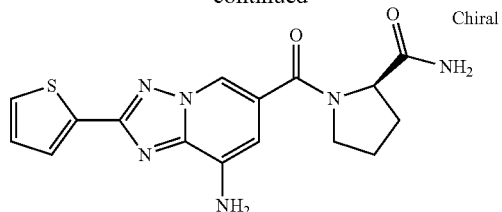
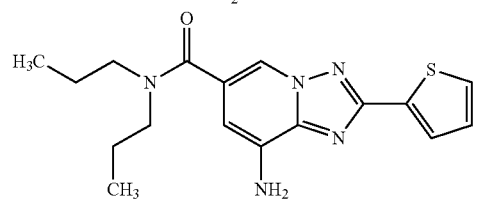
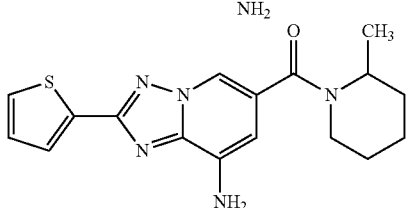
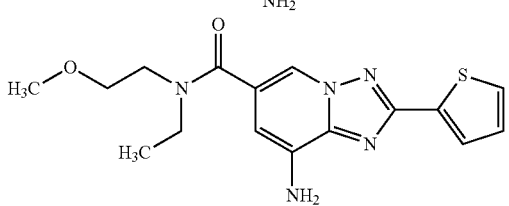
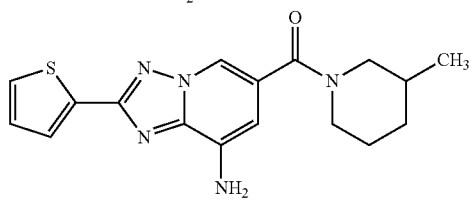
In another embodiment, the adenosine A2a pathway antagonist has one of the formulas:
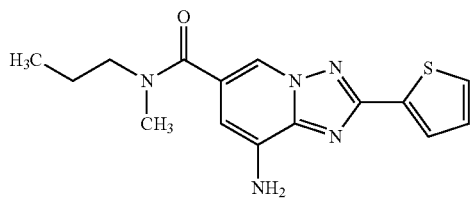

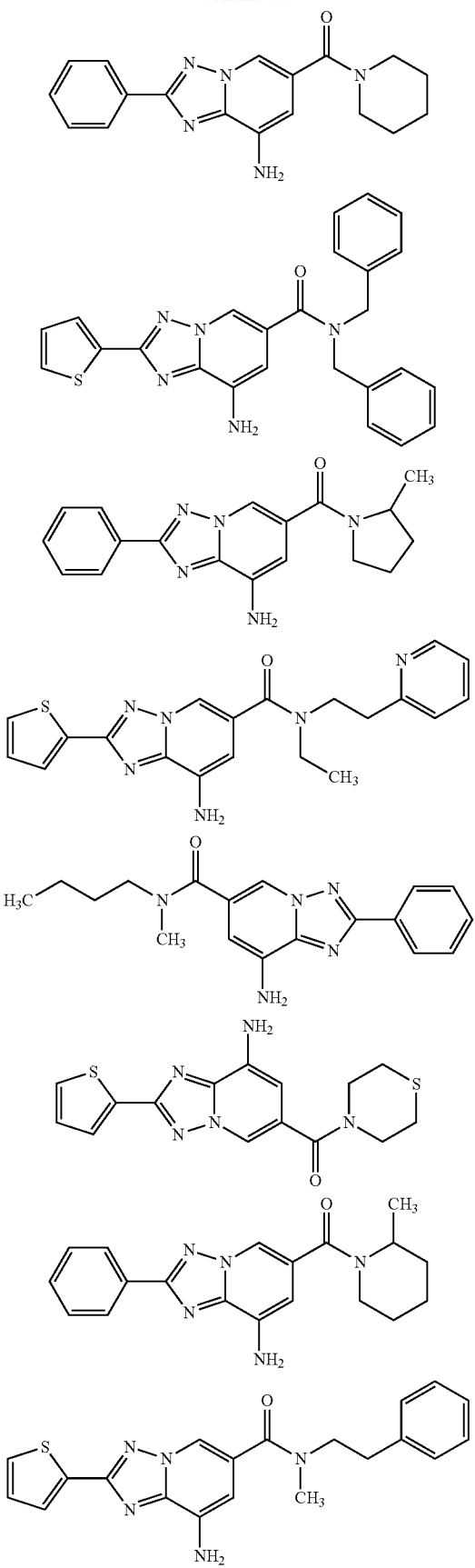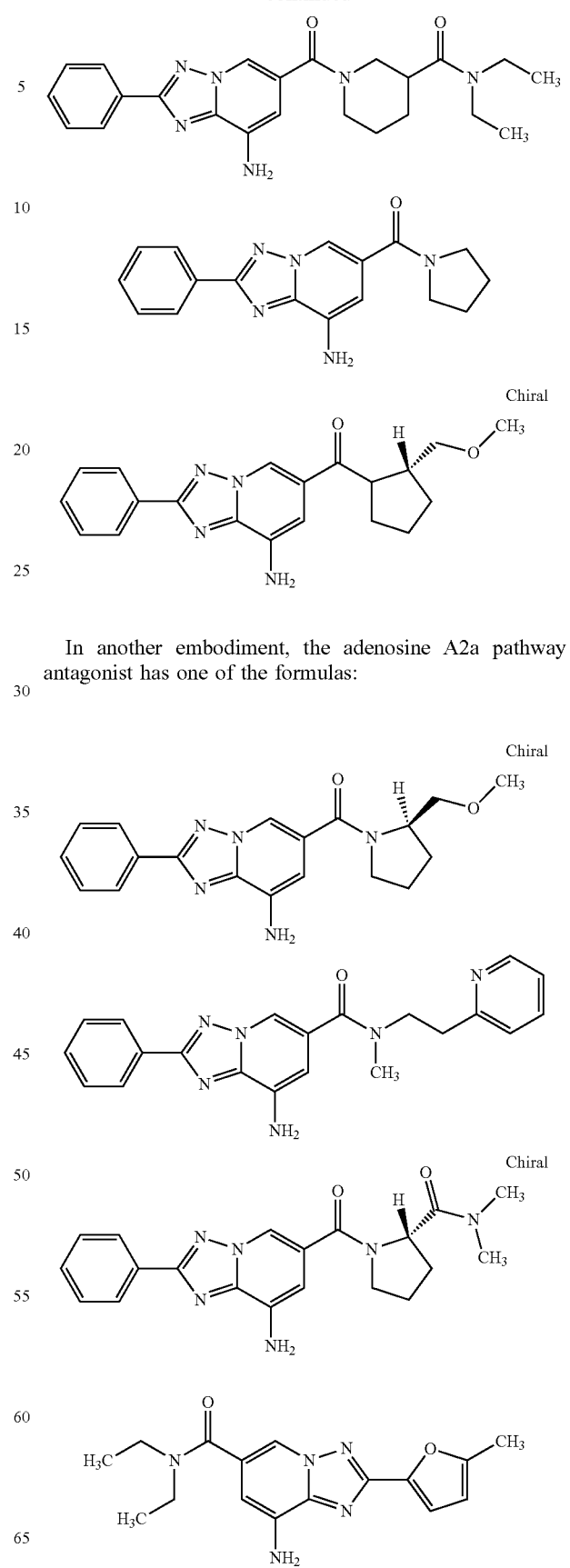
In another embodiment, the adenosine A2a pathway antagonist has one of the formulas:

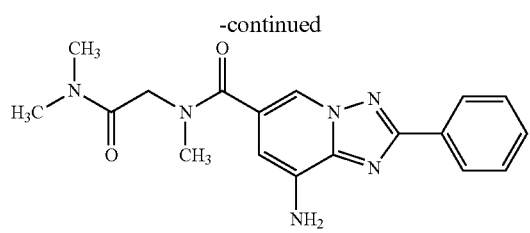
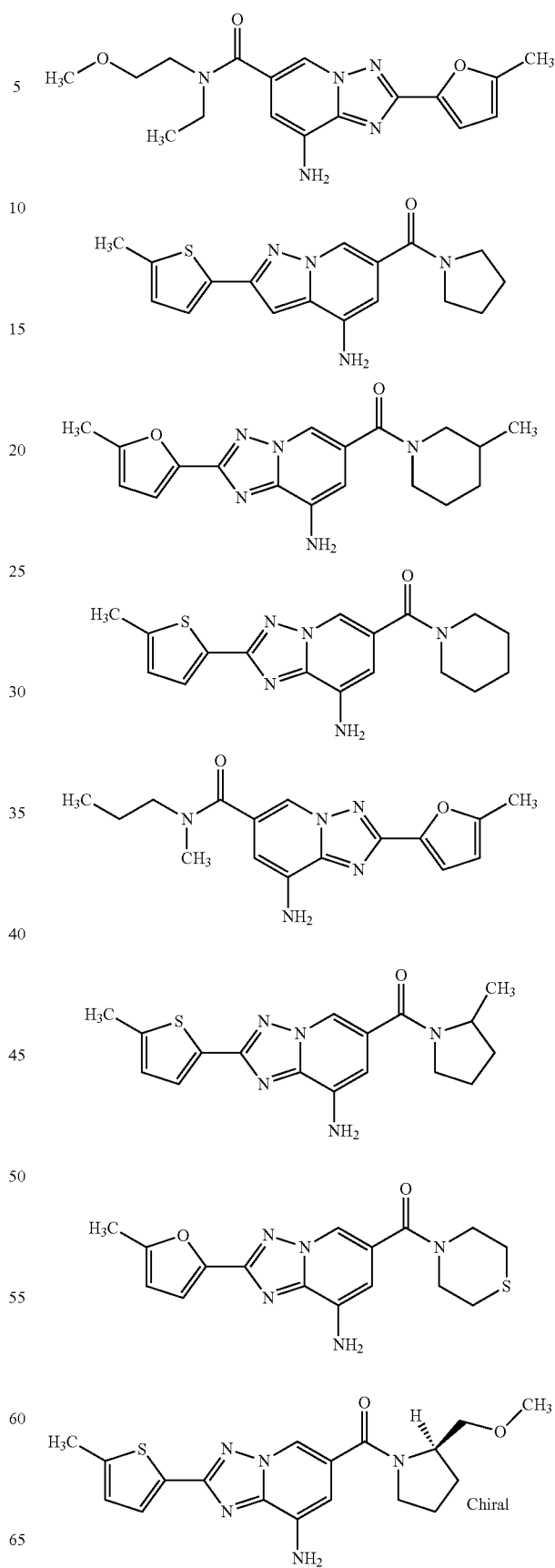
In another embodiment, the adenosine Ata pathway antagonist has one of the formulas:

-continued

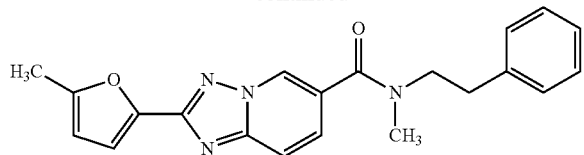
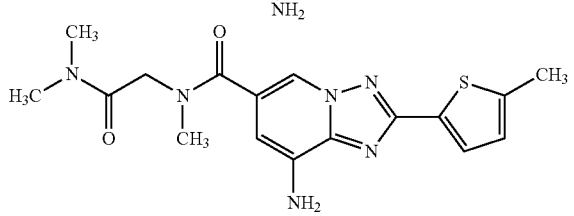
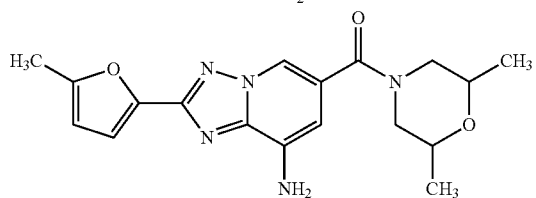
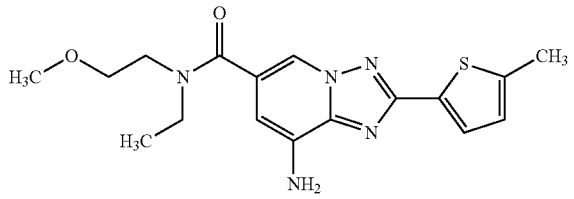
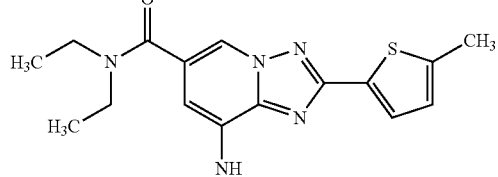

In another embodiment, the adenosine A2a pathway antagonist has one of the formulas:

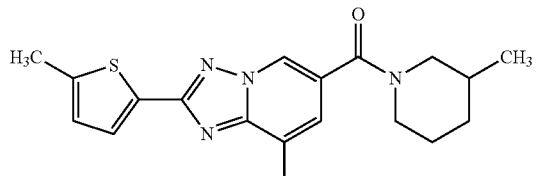
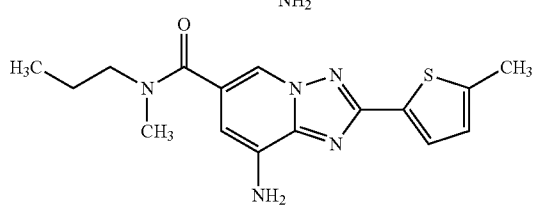
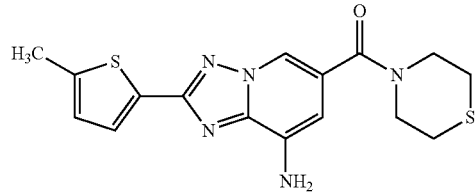

-continued

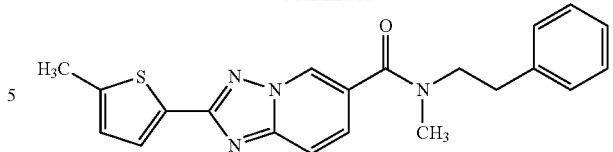
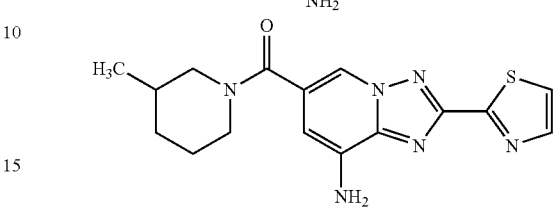
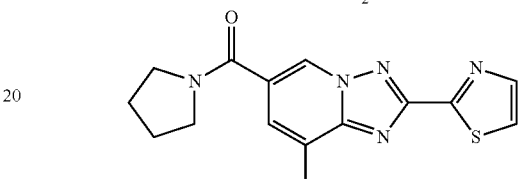
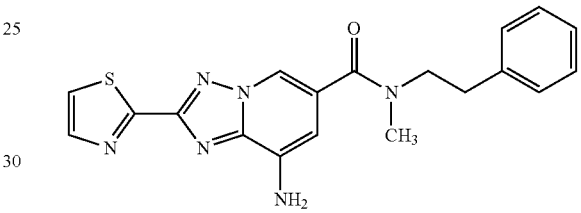
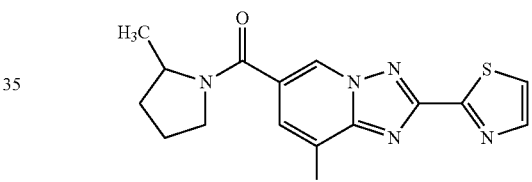
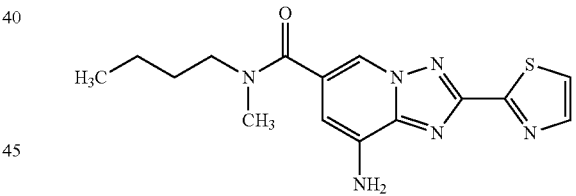

In another embodiment, the adenosine A2a pathway antagonist is a pharmaceutically acceptable salt of one of the above adenosine A2a pathway antagonists. In another embodiment, the adenosine A2a pathway antagonist is a related compound with adenosine A2a pathway antagonist activity In another embodiment, the adenosine A2a pathway antagonist an antagonist adenosine A2a receptor.

In another embodiment, the adenosine A2a pathway antagonist is any other A2a pathway antagonist known in the art. Each adenosine A2a pathway antagonist represents a separate embodiment of the present invention. Each substituent in each position indicated above as having different substituents represents a separate embodiment of the present invention.

In another embodiment, the adenosine A2a receptor that is antagonized is an ADORA2 receptor. In another embodiment, the adenosine A2a receptor is an RDC8 receptor. In another embodiment, the adenosine A2a receptor is an hA2aR receptor.

In another embodiment, the sequence of the target adenosine A2a receptor is:

(SEQ ID No: 270)
MPIMGSSVYITVELAIAVLAILGNVLVCWAVWLNSNLQNVTNYFVVSLAA

ADIAVGVLAIPFAITISTGFCAACHGCLFIACFVLVLTQSSIFSLLAIAI

DRYIAIRIPLRYNGLVTGTRAKGIIAICWVLSFAIGLTPMLGWNNCGQPK

EGKNHSQGCGEGQVACLFEDVVPMNYMVYFNFFACVLVPLLLMLGVYLRI

FLAARRQLKQMESQPLPGERARSTLQKEVHAAKSLAIIVGLFALCWLPLH

IINCFTFFCPDCSHAPLWLMYLAIVLSHTNSVVNPFIYAYRIREFRQTFR

KIIRSHVLRQQEPFKAAGTSARVLAAHGSDGEQVSLRLNGHPPGVWANGS

APHPERRPNGYALGLVSGGSAQESQGNTGLPDVELLSHELKGVCPEPPGL

DDPLAQDGAGVS.

In another embodiment, the adenosine A2a receptor is a homologue of SEQ ID No: 270. In another embodiment, the adenosine A2a receptor is a variant of SEQ ID No: 270. In another embodiment, the adenosine A2a receptor is an isomer of SEQ ID No: 270. In another embodiment, the adenosine A2a receptor is a fragment of SEQ ID No: 270. In another embodiment, the adenosine A2a receptor comprises SEQ ID No: 270. Each possibility represents a separate embodiment of the present invention.

In another embodiment, the sequence of the target adenosine A2a receptor is:

(SEQ ID No: 271)
MLLETQDALYVALELVIAALSVAGNVLVCAAVGTANTLQTPTNYFLVSLA

AADVAVGLFAIPFAITISLGFCTDFYGCLFLACFVLVLTQSSIFSLLAVA

VDRYLAICVPLRYKSLVTGTRARGVIAVLWVLAFGIGLTPFLGWNSKDSA

TNNCTEPWDGTTNESCCLVKCLFENVVPMSYMVYFNFFGCVLPPLLIMLV

IYIKIFLVACRQLQRTELMDHSRTTLQREIHAAKSLAMIVGIFALCWLPV

HAVNCVTLFQPAQGKNKPKWAMNMAILLSHANSVVNPIVYAYRNRDFRYT

FHKIISRYLLCQADVKSGNGQAGVQPALGVGL.

In another embodiment, the adenosine A2a receptor is a homologue of SEQ ID No: 271. In another embodiment, the adenosine A2a receptor is a variant of SEQ ID No: 271. In another embodiment, the adenosine A2a receptor is an isomer of SEQ ID No: 271. In another embodiment, the adenosine A2a receptor is a fragment of SEQ ID No: 271. In another embodiment, the adenosine A2a receptor comprises SEQ ID No: 271. Each possibility represents a separate embodiment of the present invention.

In another embodiment, the adenosine A2a receptor has an AA sequence set forth in one of the following GenBank entries: BC025722, M97759, and BC013780. In another embodiment, the adenosine A2a receptor has a nucleotide sequence set forth in one of the above GenBank entries. In another embodiment, the adenosine A2a receptor is a homologue of a sequence set forth in one of the above GenBank entries. In another embodiment, the adenosine A2a receptor is a variant of a sequence set forth in one of the above GenBank entries. In another embodiment, the adenosine A2a receptor is an isomer of a sequence set forth in one of the above GenBank entries. In another embodiment, the adenosine A2a receptor is a fragment of a sequence set forth in one of the above GenBank entries. In another embodiment, the adenosine A2a receptor comprises a sequence set forth in one of the above GenBank entries. Each possibility represents a separate embodiment of the present invention.

In another embodiment, a DP receptor antagonist is utilized in methods and compositions of the present invention. In another embodiment, a DP-1 receptor antagonist is utilized. In another embodiment, the DP-1 receptor antagonist is one that is used to treat allergic rhinitis. Each possibility represents a separate embodiment of the present invention.

In another embodiment, the DP receptor antagonist utilized in methods and compositions of the present invention has the structure:

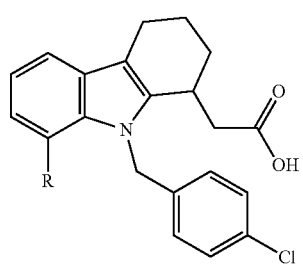

wherein R is selected from F, H, isopropyl, Br, CHO, CH$_2$OH, CON(CH$_3$)$_2$, CONH-phenol, SCH$_3$, SOCH$_3$, SO-ethanol, SO-isopropanol, SO-phenol, SO-boron nitride, and SO$_2$CH$_3$.

In another embodiment, the DP receptor antagonist has the structure:

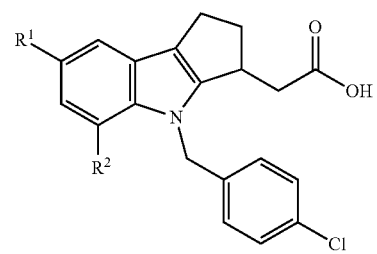

wherein R$^1$ is selected from H, SO$_2$CH$_3$, and SO$_2$NCH$_3$. and R$^2$ is selected from F, H, isopropyl, Br, CHO, CH$_2$OH, CON(CH$_3$)$_2$, CONH-phenol, SCH$_3$, SOCH$_3$, SO-ethanol, SO-isopropanol, SO-phenol, SO-boron nitride, CH=CH2, Cy (cyclohexyl), CN, 2-thiophene, COCH$_2$, CH(OH)CH$_3$, and SO$_2$CH$_3$.

In another embodiment, the DP receptor antagonist has the structure:

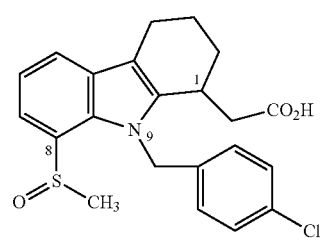 [SMILES: CS(=O)c1cccc2c3c(n(Cc4ccc(Cl)cc4)c12)C(CC(=O)O)CCC3]

In another embodiment, the DP receptor antagonist has one of the structures:

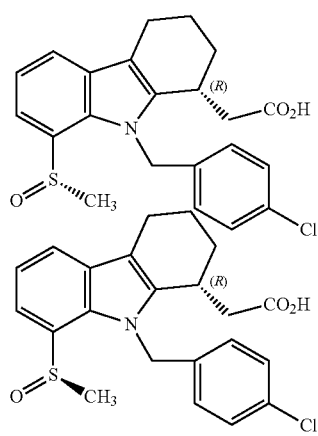

In another embodiment, the DP receptor antagonist is 2-[(1R)-9-(4-chlorobenzyl)-8-((R)-methyl-sulfinyl)-2,3,4,9-tetrahydro-1H-carbazol-1-yl]acetic acid. In another embodiment, the DP receptor antagonist is 2-[(1R)-9-(4-chlorobenzyl)-8-((S)-methyl-sulfinyl)-2,3,4,9-tetrahydro-1H-carbazol-1-yl]acetic acid. In another embodiment, the DP receptor antagonist is a mixture of 2-[(1R)-9-(4-chlorobenzyl)-8-((R)-methyl-sulfinyl)-2,3,4,9-tetrahydro-1H-carbazol-1-yl]acetic acid and 2-[(1R)-9-(4-chlorobenzyl)-8-((S)-methyl-sulfinyl)-2,3,4,9-tetrahydro-1H-carbazol-1-yl]acetic acid.

In another embodiment, the synthetic route for preparing one of the above DP receptor antagonist comprises the steps in Scheme 1:

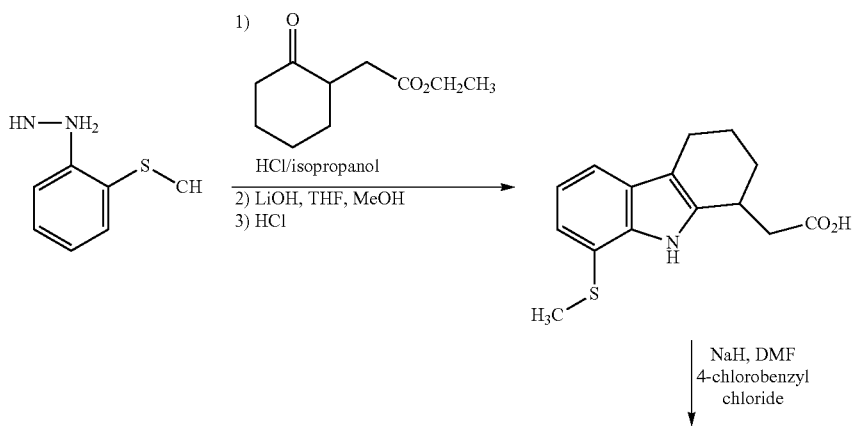

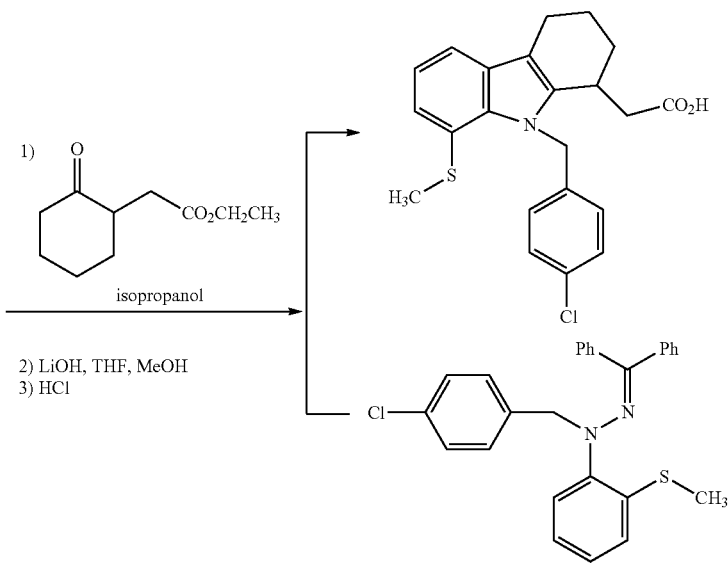

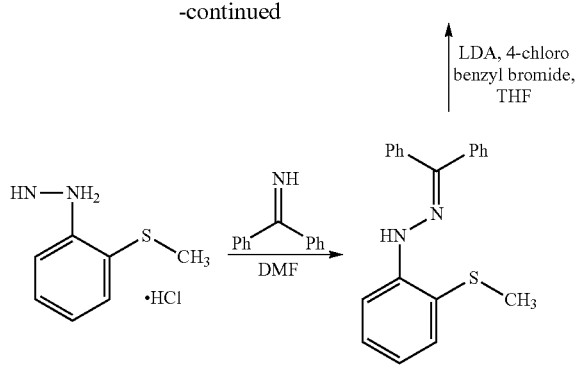
In another embodiment, the synthetic route for preparing one of the above DP receptor antagonist comprises the steps in Scheme 2:
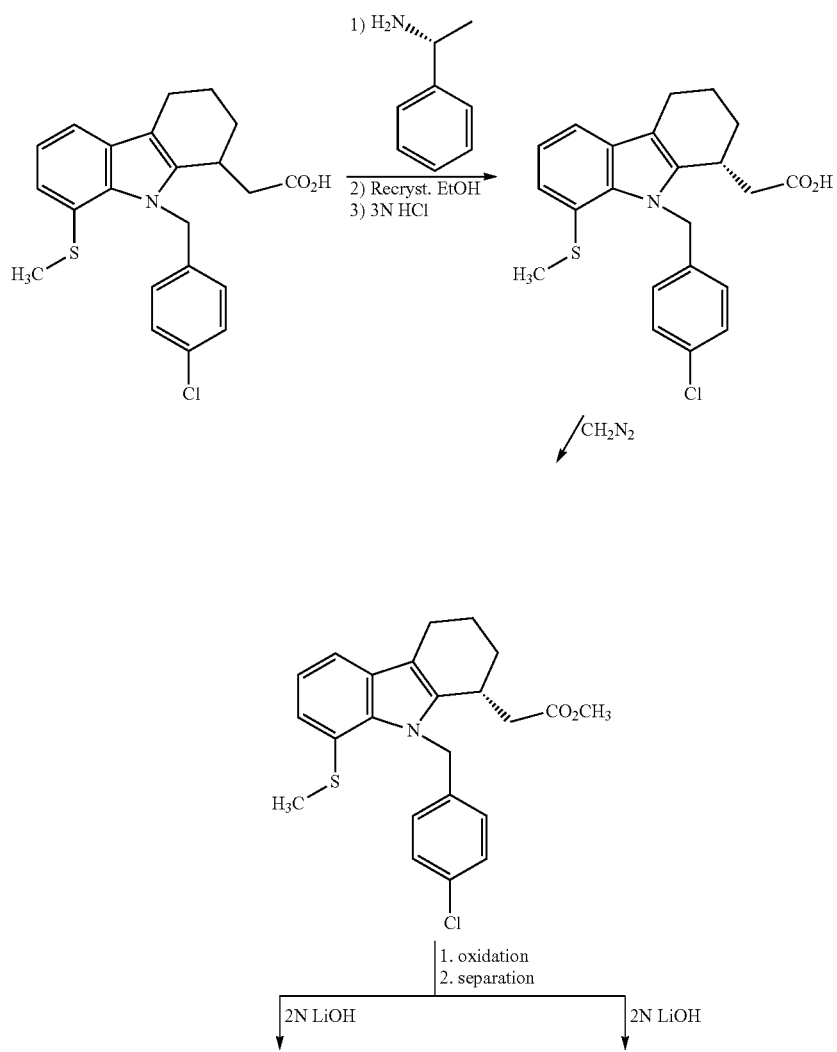

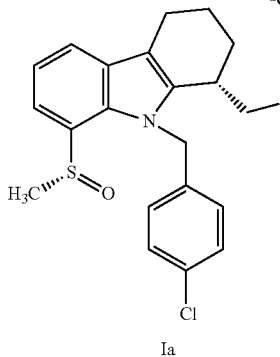

Ia

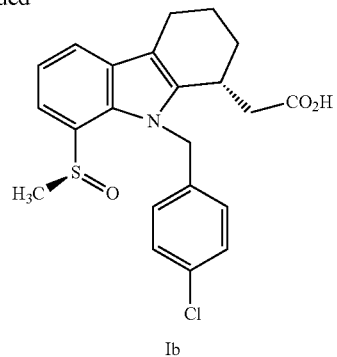

Ib

In another embodiment, the DP receptor antagonist is a variant of the previous structure, wherein the upper right cyclopentyl group is substituted for by a cyclohexyl group. Each of the substituents enumerated for the previous structure can be used for this cyclohexyl-containing structure, and each represents a separate embodiment of the present invention.

In another embodiment, the DP receptor antagonist has one of the following structures:

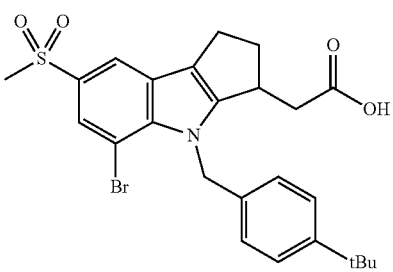

29

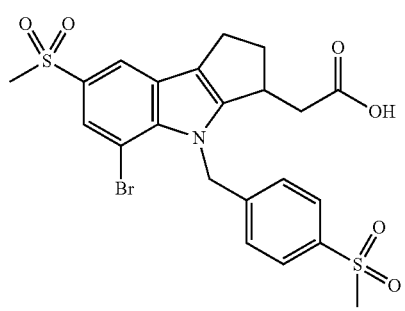

30

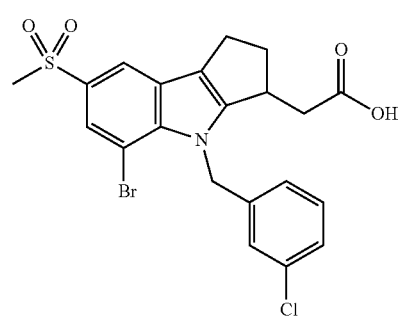

31

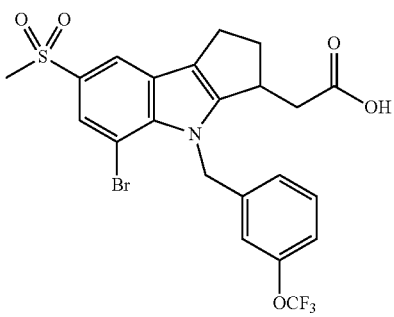

32

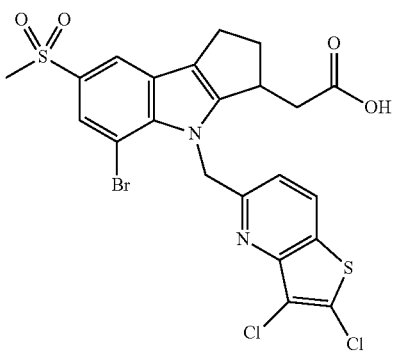

33

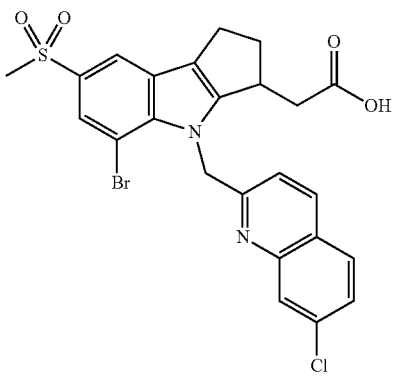

34

In another embodiment, the DP receptor antagonist has one of the following structures:

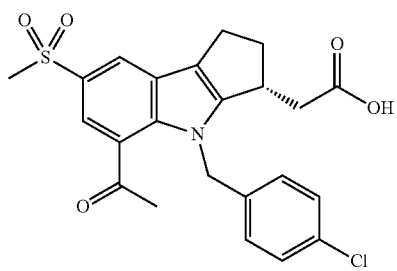

35

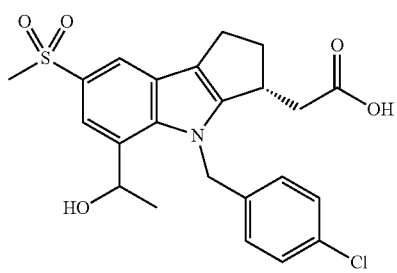

36

In another embodiment, the DP receptor antagonist is a stereoisomer of 1 of the above structures. In another embodiment, the DP receptor antagonist has an R configuration at the acetic acid side chain. In another embodiment, the DP receptor antagonist is any other stereoisomer of 1 of the above structures. In another embodiment, the DP receptor antagonist is or a compound related to 1 of the above structures, that has DP receptor antagonist activity.

Preparation of the above compounds involves, in another embodiment, a Fischer-indole reaction as the key step in their synthesis (Scheme 1 below). In another embodiment, arylhydrazines (37) are treated with ethyl 2-oxocyclohexanecarboxylate (38) in acetic acid to furnish the corresponding indoles (39). In another embodiment, standard benzylation and ester hydrolysis provides the target compounds (41).

Scheme 1. Synthesis of tetrahydrocarbazole series. Reagents and condition: (a) AcOH; (b) NaH, DMF, 0° C., 4-ClC6H4CH2Br; (c) NaOH, H2O, MeOH, THF.

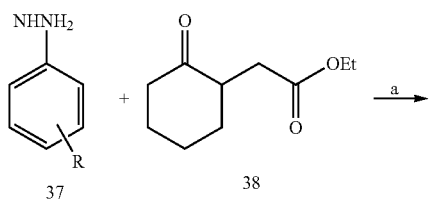

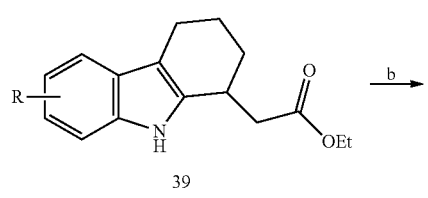

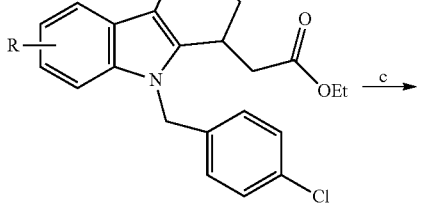

40

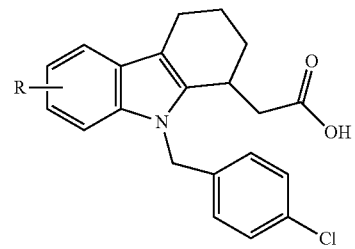

41

In another embodiment (e.g. in the case of a tetrahydrocyclopenta[b]indole series, the indole core is constructed via a palladium mediated reaction between an ortho-iodoaniline and a cyclopentanone as illustrated by the synthesis of 27 shown in Scheme 2. In another embodiment, after iodination of aniline 42, condensation with ethyl 2-oxocyclopentanecarboxylate followed by treatment with Pd(OAc)2 in DMF yields the desired indole 44. In another embodiment, selective bromination at the 7-position is performed through the actions of pyridinium tribromide to provide 45. In another embodiment, following standard benzylation, a Stille coupling of 46 with 1-(ethoxyvinyl) tributylstannane followed by acidic work-up generates ketone 47. In another embodiment, ester hydrolysis delivers the DP receptor antagonist 27.

Scheme 2. Synthesis of tetrahydrocyclopenta[b]indole series. Reagents and conditions: (a) I2, EtOH, AgSO4; (b) ethyl 2 - oxocyclopentanecarboxylate, Pd(OAc)2 DMF; (c) pyrHBr—Br2, pyr, Zn, AcOH; (d) NaH, DMF, 0° C.; 4-ClC6H4CH2Br; (e) 1-1-ethoxyvinylstannane, Pd2(dba)3, Ph3As, DMF, 100° C.; 2-aq HCl; (f) NaOH, H2O, MeOH, THF.

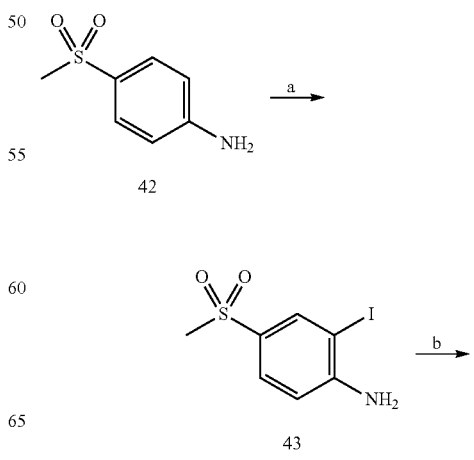

-continued

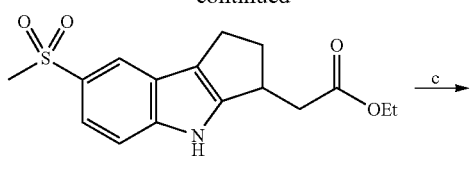<br>
44

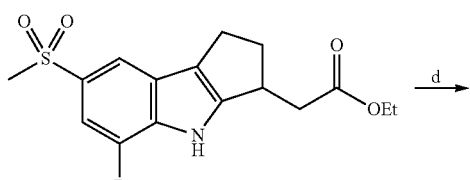<br>
45

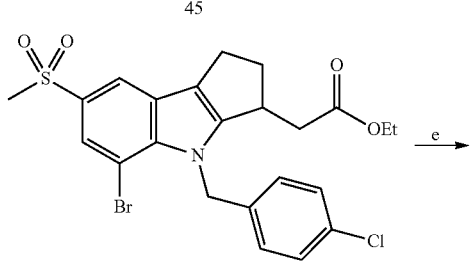<br>
46

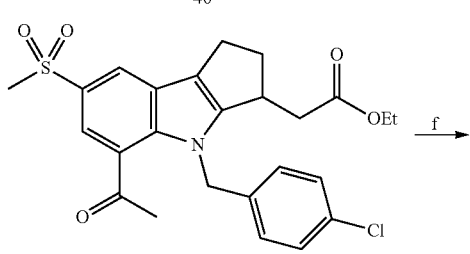<br>
47

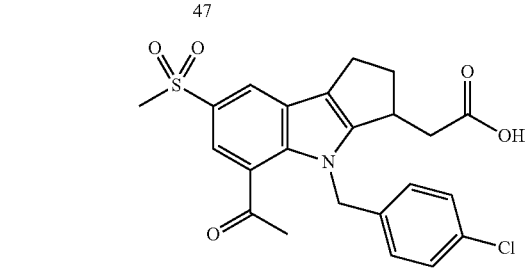<br>
27

In another embodiment, the DP receptor antagonist has the following structure:

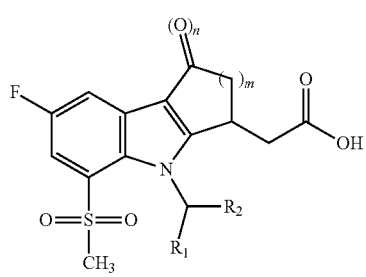

wherein n is 0 or 1; m is 1, 2 or 3; $R_1$ is H, $C_1$-$C_3$ alkyl, halogenated $C_1$-$C_3$ alkyl or cyclopropyl; $R_2$ is 4-chlorophenyl or 2,4,6-trichlorophenyl.

In another embodiment, the above DP receptor antagonist has the following stereochemistry:

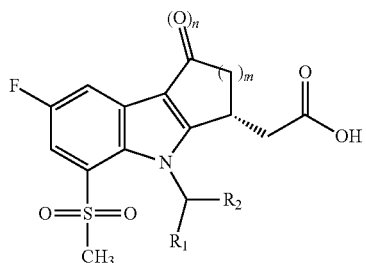

In another embodiment, the above DP receptor antagonist is [4-(4-chlorobenzyl)-7-fluoro-5-(methanesulfon-yl)-1,2,3,4-tetrahydrocyclopenta[b]-indol-3-yl]acetic acid. In another embodiment, the above DP receptor antagonist is {4-[1-(4-chlorophenyl)ethyl]-7-fluoro-5-methanesulfonyl-1,2,3,4-tetrahydrocyclopenta[b]indol-3-yl}acetic acid. In another embodiment, the above DP receptor antagonist is [9-(4-chlorobenzyl)-6-fluoro-8-methanesulfonyl-2,3,4,9-tetrahydro-1H-carbazol-1-yl]-acetic acid. In another embodiment, the above DP receptor antagonist is [4-(4-chlorobenzyl)-7-fluoro-5-methanesulfonyl-1-oxo-1,2,3,4-tetrahydrocyclopenta-[b]indol-3-yl]acetic acid.

In another embodiment, the above DP receptor antagonist is (3R)-[4-(4-chlorobenzyl)-7-fluoro-5-(methane-sulfonyl)-1,-2,3,4-tetrahydrocyclopenta[b]indol-3-yl]acetic acid. In another embodiment, the above DP receptor antagonist is (.+-.)-4-[1-(4-chlorophenyl)ethyl]-7-fluoro-5-methanesulfonyl-1,2,3,4-tetrahydrocyclopenta[b]indol-3-yl}acetic acid. In another embodiment, the above DP receptor antagonist is (.+-.)-[9-(4-chlorobenzyl)-6-fluoro-8-methane-sulfonyl-2,-3,4,9-tetrahydro-1H-carbazol-1-yl]acetic acid and pharmaceutically acceptable salts thereof. In another embodiment, the above DP receptor antagonist is [4-(4-chlorobenzyl)-7-fluoro-5-methane-sulfonyl-1-oxo-1,2-,3,4-tetrahydro-cyclopenta[b]indol-3-yl]acetic acid.

In another embodiment, the DP receptor antagonist has the following structure:

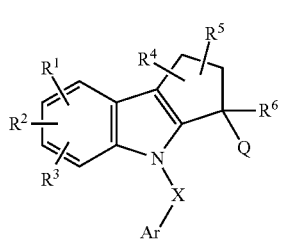

wherein:
R1, $R^2$ and $R^3$ are each independently selected from the group consisting of:
(1) hydrogen, and (2) $R^c$,
$R^4$ and $R^5$ are each independently selected from the group consisting of:
(1) H, (2) F, (3) CN, (4) $C_{1-6}$ alkyl, (5) ORE, and (6) $S(O)_n$ $C_{1-6}$ alkyl, wherein each of said alkyl group is optionally substituted with halogen, or $R^4$ and $R^5$ on the same carbon atom may represent an oxo, or
$R^4$ and $R^5$ on the same carbon atom or on adjacent carbon atoms taken together form a 3- or 4-membered ring containing 0 or 1 heteroatom selected from N, S, or O optionally substituted with one or two groups selected from F, $CF_3$ and $CH_3$;
$R^6$ is selected from the group consisting of:
(1) H, (2) $C_{1-6}$alkyl optionally substituted with one to six groups independently selected from $OR^a$ and halogen, and (3) heterocyclyl optionally substituted with one to four halogen; or
$R^5$ and $R^6$ attached on adjacent carbon atoms together form a 3- or 4-membered ring containing 0 or 1 heteroatom selected from N, S, or O optionally substituted with one or two groups selected from F, $CF_3$ and $CH_3$;
X is selected from the group consisting of: C.dbd.O, $SO_2$, and $C_{1-4}$ alkyl wherein said alkyl is optionally substituted with one to six halogen;
Ar is phenyl each optionally substituted with one to four groups independently selected from W;
Q is $C_{1-6}$ alkyl substituted with COOH or tetrazolyl, or
Q and $R^6$ together form a 3- or 4-membered ring optionally containing a heteroatom selected from N, S, and O, and optionally substituted with one or two groups independently selected from:
(1) halogen, (2) oxo, (3) $OR^a$, (4) COOH, (5) C(O)$NHSO_2$ $R^7$, and (6) tetrazolyl, $R^7$ is selected from the group consisting of:
(1) $C_{1-6}$ alkyl optionally substituted with one to six halogen, (2) aryl, and (3) heteroaryl,
wherein said aryl and heteroaryl are optionally substituted with halogen, $OC_{1-5}$ alkyl, $C_{1-5}$ alkyl and
wherein said alkyl is optionally substituted with one to six halogen;
$R^a$ and $R^b$ are independently selected from hydrogen and $C_{1-6}$ alkyl optionally substituted with one to six halogen;
$R^c$ is
(1) halogen, (2) CN, (3) $C_{1-6}$ alkyl optionally substituted with one to six groups independently selected from halogen, $NR^a$ $R^b$, $C(O)R^a$, $C(OR^a)R^a$ $R^b$, and $OR^a$, (4) $C_2$-6 alkenyl optionally substituted with one to six groups independently selected from halogen and $OR^a$, (5) heterocyclyl, (6) aryl, (7) heteroaryl, (8) $C(O)R^a$, (9) $C(OR^a)R^a$ $R^b$, (10) $C(O)OR^a$, (11) $CONR^a$ $R^b$, (12) $OCONR^a$ $R^b$, (13) $S(O)_n$ $R^7$, (14) $NR^a$ $C(O)OC_{1-6}$ alkyl, wherein alkyl is optionally substituted with one to six halogen and (15) $S(O)_n$ $NR^a$ $R^b$,
wherein heterocyclyl, aryl, heteroaryl are optionally substituted with one to four groups independently selected from halogen; and
n is 1, 1 or 2.

In another embodiment, the DP receptor antagonist is MK-0524, MK-0524A, or MK-0524B (all obtainable from Merck), or a related compound with DP receptor antagonist activity.

In another embodiment, the DP receptor antagonist has the following structure:

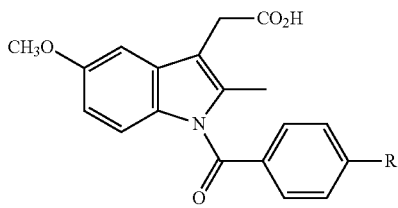

wherein R is selected from Cl or 1 of the following structures:

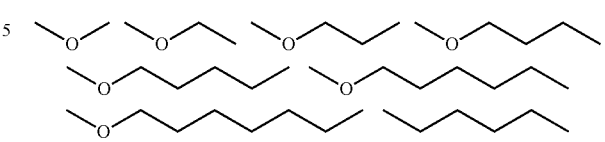

In another embodiment, the DP receptor antagonist has the structure:

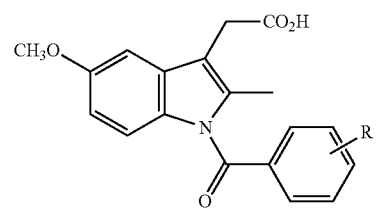

wherein R is defined as above, and the R group is at a position selected from meta, ortho, and para.

In another embodiment, the DP receptor antagonist has the following structure:

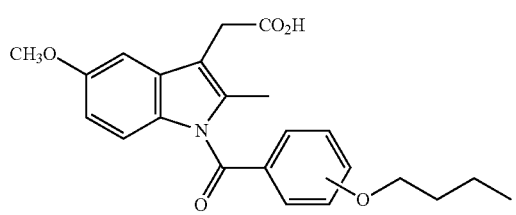

wherein the n-butyloxy group is at a position selected from meta, ortho, and para.

In another embodiment, the DP receptor antagonist has the following structure:

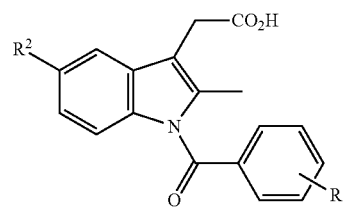

wherein R is defined as above, and $R^2$ is selected from OCH3, H, CH3, isopropyl, F, Cl, and OH.

In another embodiment, the DP receptor antagonist has the following structure:

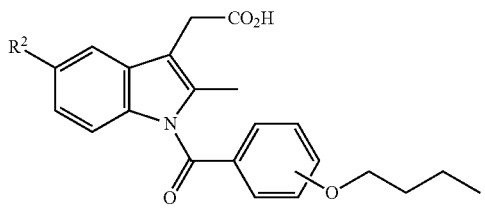

wherein R is defined as above, and R² is selected from OCH3, H, CH3, isopropyl, F, Cl, and OH.

In another embodiment, the DP receptor antagonist has the following structure:

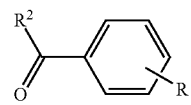

wherein R is defined as above, and R2 is selected from:

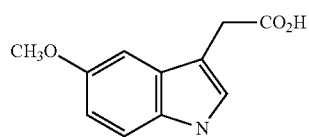

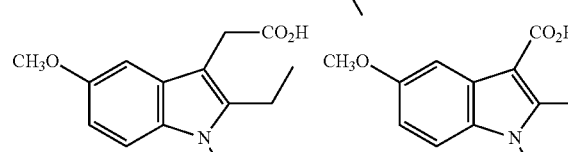

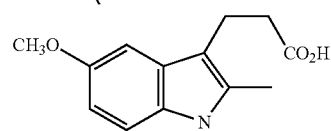

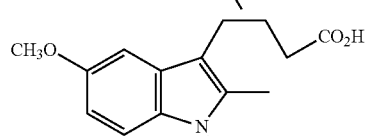

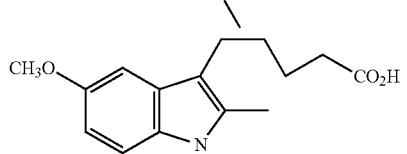

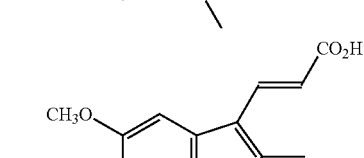

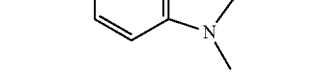

In another embodiment, the DP receptor antagonist has the following structure:

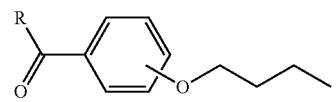

wherein R is selected from:

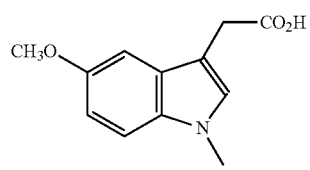

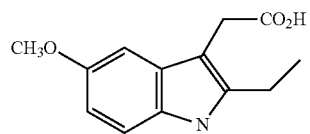

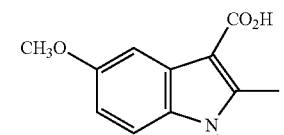

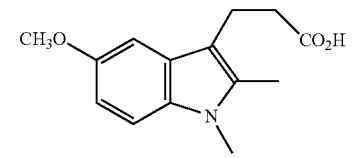

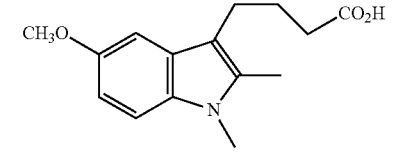

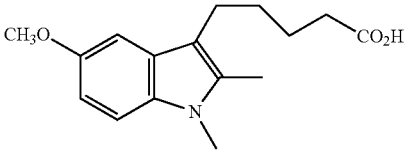

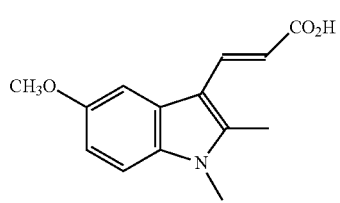

In another embodiment, the DP receptor antagonist has the following structure:

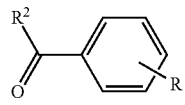

wherein R is defined as above, and R2 is selected from:
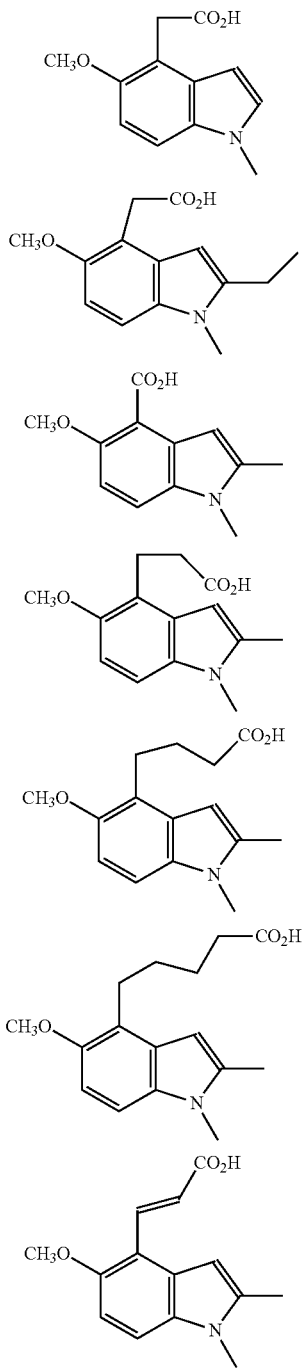
In another embodiment, the DP receptor antagonist has the following structure:
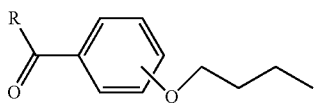
wherein R is selected from:
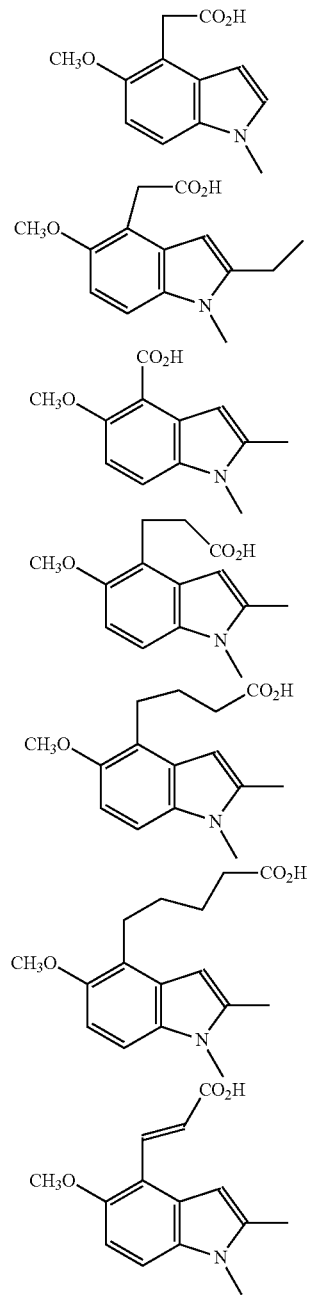
In another embodiment, the DP receptor antagonist has the following structure:
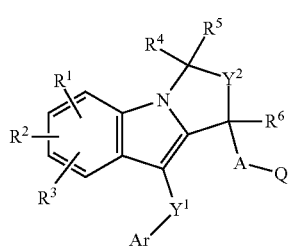
I wherein
R1, R² and R³ are each independently selected from hydrogen and $R^g$;
R⁴ is selected from H, CN, $C_{1-6}$ alkyl optionally substituted with one to six halogen, $OR^a$ and $S(O)_nC_1$-6alkyl;
R⁵ is selected from H and $C_{1-6}$ alkyl optionally substituted with one to six halogen; or
R⁴ and R⁵ together represent an oxo; or
R⁴ and R⁵ taken together form a 3- or 4-membered ring containing 0 or 1 heteroatom selected from $NR^f$, S, and O optionally substituted with one or two groups selected from F, $CF_3$ and $CH_3$;
R⁶ is selected from H and $C_{1-6}$ alkyl optionally substituted with one to six groups independently selected from $OR^a$ and halogen,
Ar is aryl or heteroaryl each optionally substituted with one to four groups independently selected from $R^g$;
A is $C_{1-3}$ alkyl optionally substituted with one to four halogen atoms, $O(CH_2)12$, $S(CH_2)_{1-2}$;
Q is selected from: (1) COOH, (2) $CONR^aR^b$, (3) $C(O)NHSO_2R^c$, (4) $SO_2NHR^a$, (5) $SO_3H$, (6) $PO_3H_2$, and (7) tetrazolyl,
$Y^1$ is —$(CR^dR^e)_a$— —X—$(CR^dR_e)_b$—, phenylene, $C_{3-6}$ cycloalkylidene or $C_3$-6cycloalkylene, wherein a and b are integers 0-1 such that the sum of a and b equals 0, 1 or 2;
X is a bond, O, S, $NR^a$, C(O), OC(O), C(O)O, $C(O)NR^a$, $OC(O)NR^a$, $NR^aC(O)$, $CR^{d.4}dbd.CR^e$ or C.ident.C;
$Y^2$ is $CR^dR^e$, $CR^dR^e$—$CR^dR^e$, or $CR^d.dbd.CR^e$,
$R^a$ and $R^b$ are independently selected from H, $C_{1-10}$ alkyl, $C_{2-10}$ alkenyl, $C_{2-10}$ alkynyl, Cy and Cy $C_{1-10}$ alkyl, wherein alkyl, alkenyl, alkynyl and Cy are optionally substituted with one to six substituents independently selected from halogen, amino, carboxy, $C_{1-4}$ alkyl, $C_{1-4}$ alkoxy, aryl, heteroaryl, aryl $C_{1-4}$ alkyl, hydroxy, $CF_3$, $OC(O)C_{1-4}$ alkyl, $OC(O)NR^iR^i$, and aryloxy; or
$R^a$ and $R^b$ together with the atom(s) to which they are attached form a heterocyclic ring of 4 to 7 members containing 0-2 additional heteroatoms independently selected from oxygen, sulfur and N—$R^f$;
$R^c$ is selected from $C_{1-6}$ alkyl optionally substituted with one to six halogen, aryl and heteroaryl, wherein said aryl and heteroaryl are optionally substituted with halogen, $OC_{1-6}$ alkyl, $C_{1-6}$alkyl and wherein said alkyl is optionally substituted with one to six halogen;
$R^d$ and $R^e$ are independently selected from H, halogen, aryl, heteroaryl, $C_{1-6}$ alkyl or halo$C_{1-6}$ alkyl, or
$R^f$ is selected from H, $C_{1-6}$ alkyl, halo$C_{1-6}$ alkyl, Cy, C(O)$C_{1-6}$ alkyl, C(O)halo$C_{1-6}$ alkyl, and C(O)-Cy,
$R^g$ is selected from (1) halogen, (2) CN, (3) $C_{1-6}$ alkyl optionally substituted with one to eight groups independently selected from aryl, heteroaryl, halogen, $NR^aR^b$, C(O)$R^a$, $C(OR^a)R^aR^b$, $SR^a$ and $OR^a$, wherein aryl, heteroaryl and alkyl are each optionally substituted with one to six groups independently selected from halogen, $CF_3$, and COOH, (4) $C_{2-6}$alkenyl optionally substituted with one to six groups independently selected from halogen and $OR^a$, (5) Cy (6) C(O)$R^a$, (7) C(O)O$R^a$, (8) $CONR^aR^b$, (9) $OCONR^aR^b$, (10) $OC_{1-6}$ alkyl, wherein alkyl is optionally substituted with one to six substituents selected from halogen, aryl, heteroaryl, OH and OC(O)$R^a$, (11) O-aryl (12) O-heteroaryl (13) $S(O)_nC_{1-6}$ alkyl, wherein alkyl is optionally substituted with one to six substituents selected from halogen, aryl, heteroaryl, OH, and OC(O)$R^a$, (14) S(O)$_n$aryl, (15) S(O)nheteroaryl, (16) —$NR^aS(O)_nR^b$, (17) —$NR^aR^b$, (18) —$NR^aC(O)R^b$, (19) —$NR^aC(O)OR^b$, (20) —$NR^aC(O)NR^aR^b$, (21) $S(O)_nNR^aR^b$, (22) $NO_2$, (23) $C_{5-8}$cycloalkenyl, wherein Cy is optionally substituted with one to eight groups independently selected from halogen, C(O)$R^a$, $OR^a$, $C_{1-3}$ alkyl, aryl, heteroaryl and $CF_3$;
$R^i$ and $R^j$ are independently selected from hydrogen, $C_{1-10}$ alkyl, Cy and Cy-$C_{1-10}$ alkyl; or
$R^i$ and $R^j$ together with the carbon to which they are attached form a ring of 5 to 7 members containing 0-2 heteroatoms independently selected from oxygen, sulfur and nitrogen;
Cy is selected from heterocyclyl, aryl, and heteroaryl; and
n is 0, 1 or 2.

In another embodiment, a DP receptor antagonist of the formula I above has the structure:

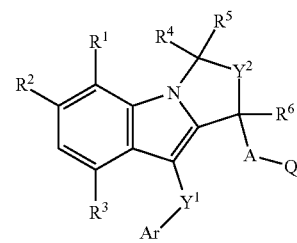

In another embodiment, a DP receptor antagonist of formula I above has the structure:

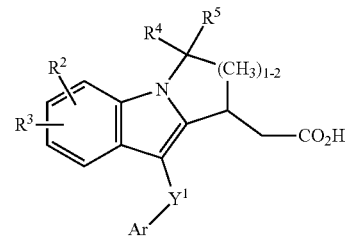

wherein $Y^1$ is O, S, C(O) or $CH_2$, R⁴ and R⁵ are each hydrogen or R⁴ and R⁵ together represent oxo, and R² and R³ represent one or two non-H substituents.

In another embodiment, a DP receptor antagonist of formula I above has the structure:

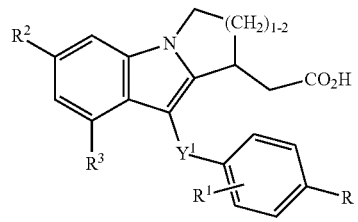

wherein $Y^1$ is C(O), $CH_2$ or S, R and R' are independently hydrogen, halogen, cyano, $C_{1-3}$ alkanoyl or $CF_3$, R² is selected from halogen, $S(O)_nC_{1-3}$ alkyl, $OC_{1-6}$ alkyl (optionally substituted with aryl), CN, $C_2$-6alkenyl, 1- or 2-methyltetrazolyl, 1-methylpyroolyl and $C_{1-6}$ alkyl, and R³ is selected from halogen, $S(O)_nC_{1-3}$ alkyl, $OC_{1-6}$ alkyl, C(O)$R^a$, $C_{1-6}$ alkyl (optionally substituted with 3 to 6 halogen atoms, and 0 or 1 group selected from $OR^a$, $SR^a$), $C_{2-6}$ alkenyl, $C_{5-8}$ cycloalkenyl, phenyl (optionally substituted with a group selected from $C_{1-3}$ alkyl, $OR^a$ and pyrazolyl), naphthyl, and heteroaryl selected from pyrrolyl, thienyl, pyrazolyl, quinolinyl, benzothienyl, isoxalyl, pyridyl, each of which is optionally substituted with $C_{1-3}$ alkyl.

In another embodiment, the DP receptor antagonist is a compound with DP receptor antagonist activity, related to 1 of the above structures.

Synthesis of the above compounds is carried out, in another embodiment, as depicted in Scheme 1 below. Formation of a hydrazone of 12 with acetaldehyde in toluene, followed by N-acylation of another NH moiety with acid chlorides 13a-j, affords the N-acyl hydrazones 14a-j, respectively. Acidic hydrolysis of 14a-j, followed by conventional indole synthesis using levulinic acid, yields the N-benzoyl-5-methoxy-2-methylindole-3-acetic acids 2a-j, respectively. In another embodiment, as shown in Scheme 2 below, compounds are prepared from their corresponding 4-substituted phenylhydrazines (15a-e, respectively) according to the same procedures described above.

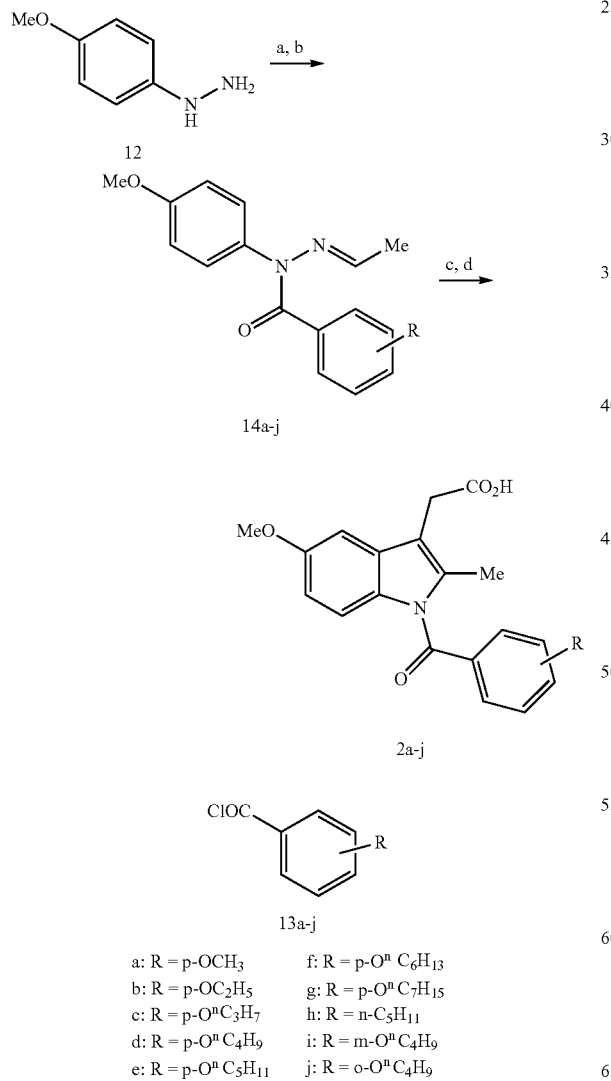

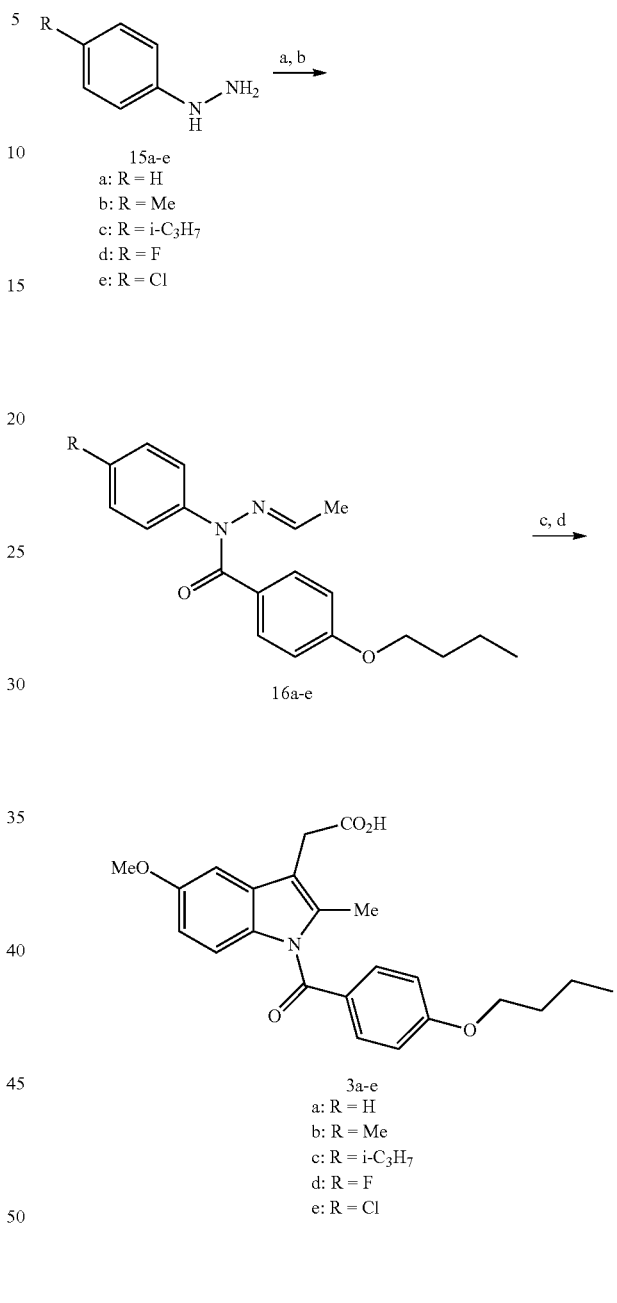

In another embodiment, synthesis of the above compounds is carried out as depicted in Scheme 3. Replacement of the methoxy moiety of 17 with a benzyloxy moiety is achieved as follows: Demethylation of the 5-methoxy group of 17 with pyridinium chloride at 180° C., followed by benzylation of a formed phenol derivative 18 with benzyl bromide, affords a benzyl ether 19, N-acylation of which followed by catalytic hydrogenation yields 4. In another embodiment, compound 5 is prepared from the corresponding indole derivative 21 according to the N-acylation procedure described above.

Scheme 3. Synthesis of 4 and 5. Reagents: (a) HCl-pyridine, 180° C.; (b) benzyl bromide, K$_2$CO$_3$, DMF (c) NaH, 13d, DMF; (d) H$_2$, Pd—C, i-PrOH, EtOAc.

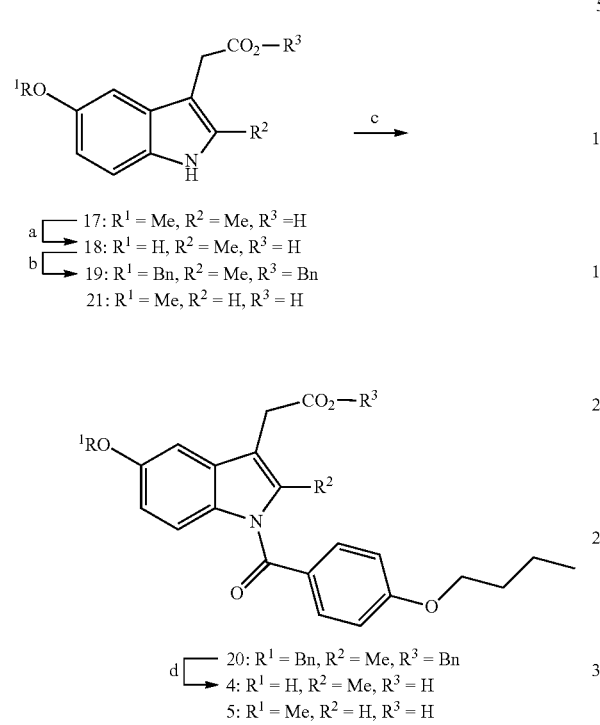

17: R$^1$ = Me, R$^2$ = Me, R$^3$ = H
18: R$^1$ = H, R$^2$ = Me, R$^3$ = H
19: R$^1$ = Bn, R$^2$ = Me, R$^3$ = Bn
21: R$^1$ = Me, R$^2$ = H, R$^3$ = H

20: R$^1$ = Bn, R$^2$ = Me, R$^3$ = Bn
4: R$^1$ = H, R$^2$ = Me, R$^3$ = H
5: R$^1$ = Me, R$^2$ = H, R$^3$ = H

In another embodiment, synthesis of the above compounds is carried out as depicted in Scheme 4. Compounds are prepared according to the usual indole synthesis procedure using N-acyl hydrazine 22 and the corresponding keto carboxylic acids 24 and 25a-c, respectively. In another embodiment, compounds are prepared by deprotection of the allyl ester 23, which was prepared from 22 and 26 by the indole synthesis procedure described above. In another embodiment, compounds are prepared from 5-methoxy-2-methylindole 27 as outlined in Scheme 5. Treatment of 27 with dimethylformamide in the presence of phosphorus oxychloride yields 28, C2 homologation of which by the Wittig reaction results in 29. Alkaline hydrolysis of 29 provides the corresponding carboxylic acid 30, N-acylation of which with 4-nbutoxybenzoylchloride in the presence of n-BuLi affords 11. In another embodiment, synthesis of 2-methylindole-4-acetic acid 1 is outlined in Scheme 6. Methoxycarbonylation of 32, which is prepared from 31 by the usual method, is carried out by the palladium-catalyzed carbon monoxide insertion reaction in the presence of methanol. Alkaline hydrolysis of 33, followed by O-benzylation, provides 35, after which N-acylation of 35 with an acid chloride 13d and deprotection with hydrogenolysis affords a carboxylic acid 37. Compound 37 is converted to 38 by the conventional C-1 homologation procedure, followed by O-benzylation. Deprotection of 38 with hydrogenolysis yields 1.

Scheme 4. Synthesis of 6-1. Reagents: (a) 24 or 25a-c or 26, AcOH; (b) morpholine, Pd(PPh$_3$)$_4$, THF.

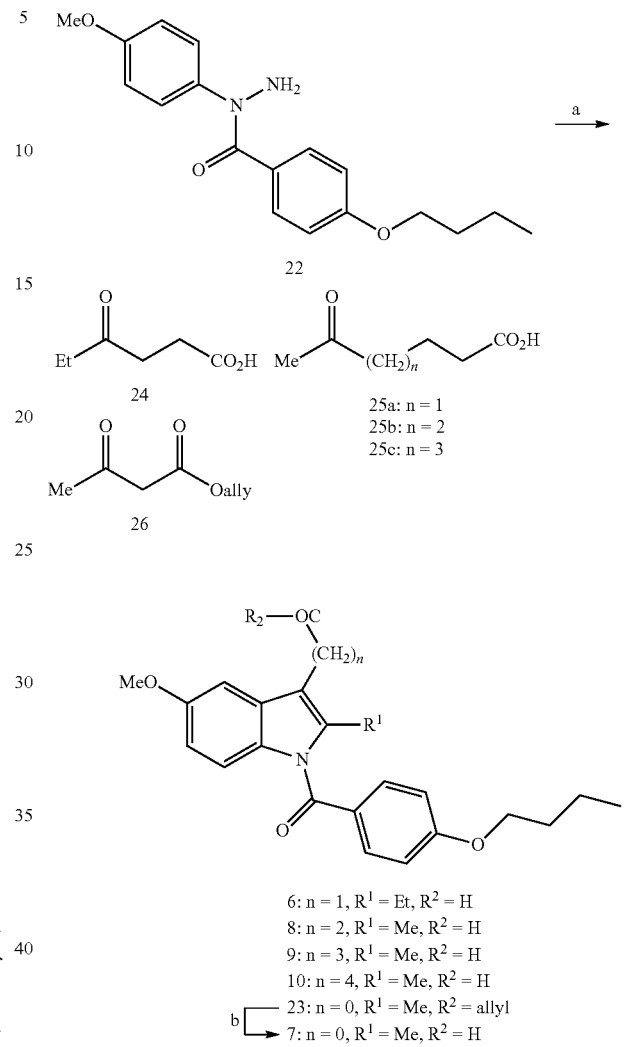

6: n = 1, R$^1$ = Et, R$^2$ = H
8: n = 2, R$^1$ = Me, R$^2$ = H
9: n = 3, R$^1$ = Me, R$^2$ = H
10: n = 4, R$^1$ = Me, R$^2$ = H
23: n = 0, R$^1$ = Me, R$^2$ = allyl
7: n = 0, R$^1$ = Me, R$^2$ = H Scheme 5. Synthesis of 11. Reagents: (a) POCl$_3$, DMF, -78° C.; (b) Br$^-$Ph$_3$P$^+$CHCO$_3$Me, benzene; (c) NaOH, H$_2$O; (d) n-BuLi, 13d, THF.

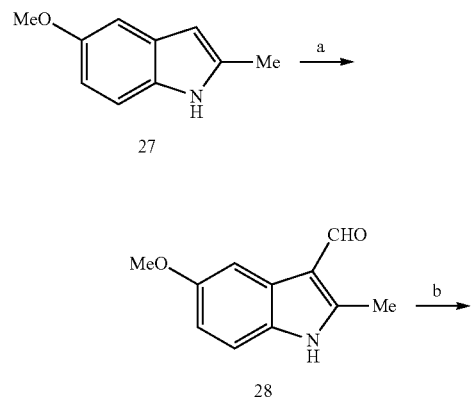

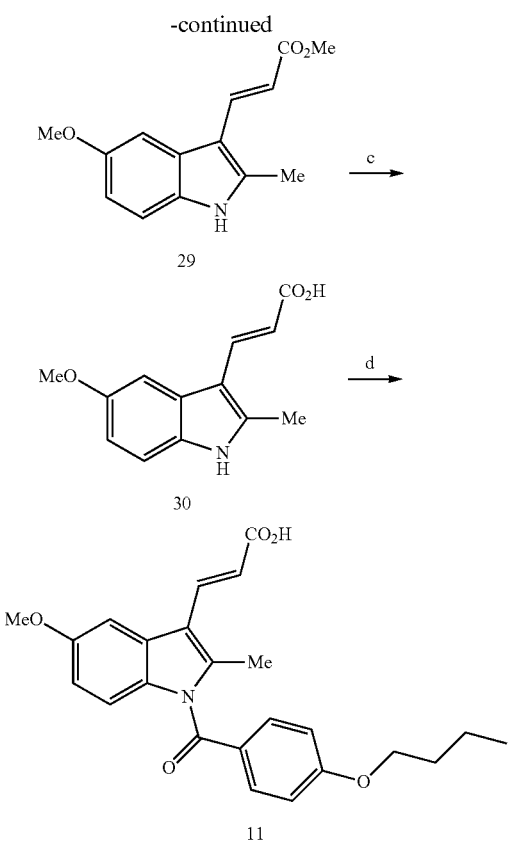
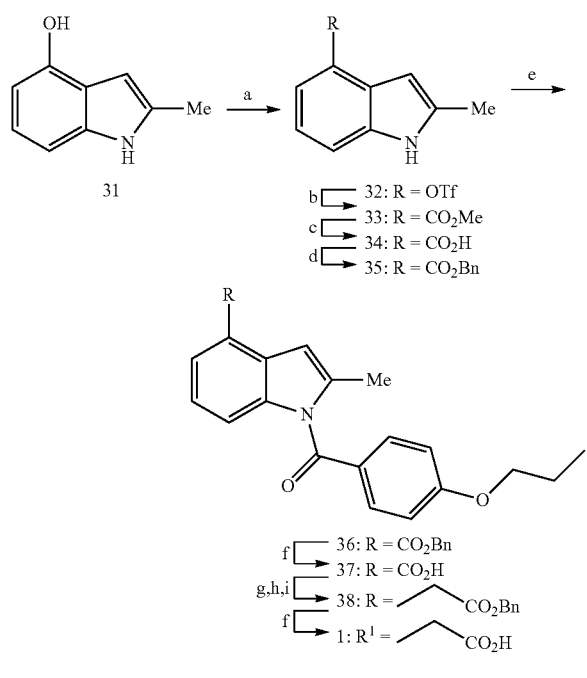

Scheme 6. Synthesis of 1. Reagents: (a) Tf₂O, 2,6-lutidine, CH₂Cl₂, -78° C.; (b) Pd(PPh₃)₄, CO, TEA, MeOH, DMF; (c) NaOH, MeOH, 1,4-dioxane; (d) benzyl bromide, K₂CO₃, DMF; (e) NaH, 13d, DMF, (f) Pd—C, H₂, MeOH, EtOAc; (g) (COCl)₂, DMF, toluene, (h) TMSCHN₂, THF, CH₃CN; (i) 2,4,6-collidine, benzyl alcohol.

In another embodiment, the DP receptor antagonist has the structure:

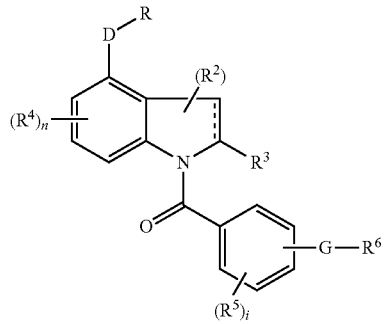

wherein:
R represents —COR1, —CH₂OR⁰, or —COOR²⁰, R⁰ represents a hydrogen atom or C2-6 acyl group, R¹ represents a hydroxyl group, $C_{1-6}$ alkoxy group, —NR⁸R⁹ wherein R⁸ and R⁹ each represents hydrogen atom, $C_{1-6}$ alkyl group, —SO₂R¹³ wherein R¹³ represents $C_{1-6}$alkyl group, $C_{3-15}$ saturated or unsaturated carbocyclic ring, or 4 to 15-membered heterocycle containing 1 to 5 of nitrogen atom(s) sulfur atom(s) and/or oxygen atom(s), R²⁰ represents allyl or benzyl group;

R² represents a hydrogen atom, $C_{1-6}$ alkyl, $C_{1-6}$ alkoxy, $C_{2-6}$ alkoxyalkyl, a halogen atom, amino, trihalomethyl, cyano, hydroxyl, benzyl, or 4-methoxybenzyl group;

R³ represents a hydrogen atom, $C_{1-6}$ alkyl, $C_{1-6}$ alkoxy, a halogen atom, trihalomethyl, cyano, or hydroxyl group;

R⁴ and R⁵ each represents a hydrogen atom, $C_{1-6}$ alkyl, $C_{1-6}$ alkoxy, $C_{2-6}$ alkoxyalkyl group, a halogen atom, nitro, amino, trihalomethyl, trihalomethoxy, cyano or hydroxyl group, D represents a single bond, $C_{1-6}$ alkylene, $C_{2-6}$ alkenylene, or $C_{1-6}$ oxyalkylene group;

--G-R⁶ represents:
1) G represents C1-6 alkylene that may be replaced by 1 or 2 of oxygen atom(s) and/or sulfur atom(s), C2-6 alkenylene that may be replaced by 1 or 2 of oxygen atom(s) and/or sulfur atom(s), wherein the alkylene and alkenylene groups may be substituted by hydroxyl or C1-4 alkoxy group, —C(O)NH—, —NHC(O)—, —SO₂NH—, —NHSO₂—, or diazo group, R⁶ represents $C_{3-15}$ saturated or unsaturated carbocyclic ring, or a 4 to 15-membered heterocycle containing 1 to 5 of nitrogen atom(s) sulfur atom(s), and/or oxygen atom(s), wherein the rings may be substituted by 1 to 5 group(s) selected from $C_{1-6}$ alkyl, $C_{1-10}$ alkoxy, $C_{2-6}$ alkoxyalkyl, a halogen atom, hydroxyl, trihalomethyl, nitro, amino, phenyl, phenoxy, oxo, $C_{2-6}$ acyl, $C_{1-6}$ alkane sulphonyl, and cyano group, or
2) together with G and R⁶,
(i) $C_{1-15}$ alkyl group that may be replaced by 1 to 5 of oxygen atom(s) and/or sulfur atom(s),
(ii) $C_{2-15}$ alkenyl group that may be replaced by 1 to 5 of oxygen atom(s) and/or sulfur atom(s), wherein the alkyl, alkenyl, and alkynyl groups may be substituted by 1 to 12 of groups selected from $C_{1-6}$ alkoxy, a halogen atom, hydroxyl, cyano, oxo groups, and —NR¹¹R¹² wherein R¹¹ and R¹² represent hydrogen atoms, $C_{1-6}$ alkyl, $C_{2-6}$ alkenyl, phenyl, benzoyl, naphthyl, phenyl groups substituted with $C_{1-6}$ alkyl group, or $C_{1-6}$ alkyl group substituted by phenyl or cyano group, respectively, n represents 1 to 3, m represents 1 to 3, i represents 1 to 4, ----- represents a single bond or a double bond, In another embodiment of the above structure, the 4 to 15-membered heterocycle that contains 1 to 5 of nitrogen, sulfur, and oxygen atom(s) in this specification is saturated. In another embodiment, the 4 to 15-membered heterocycle is unsaturated. In another embodiment, the 4 to 15-membered heterocycle is selected from the following formulas:

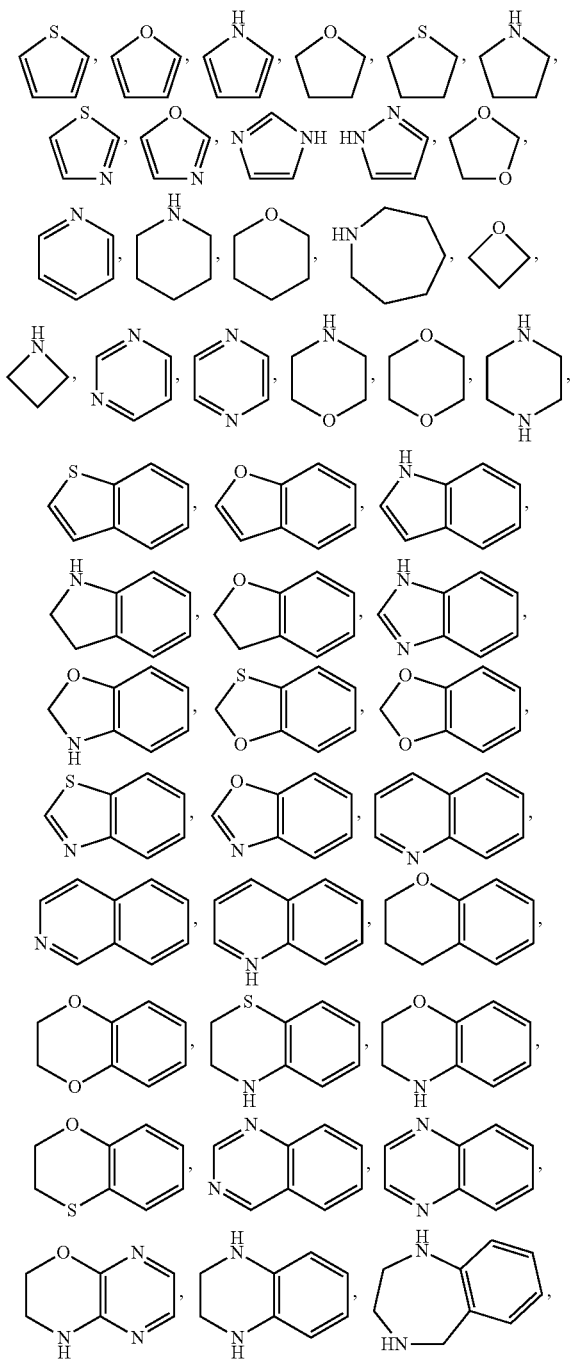

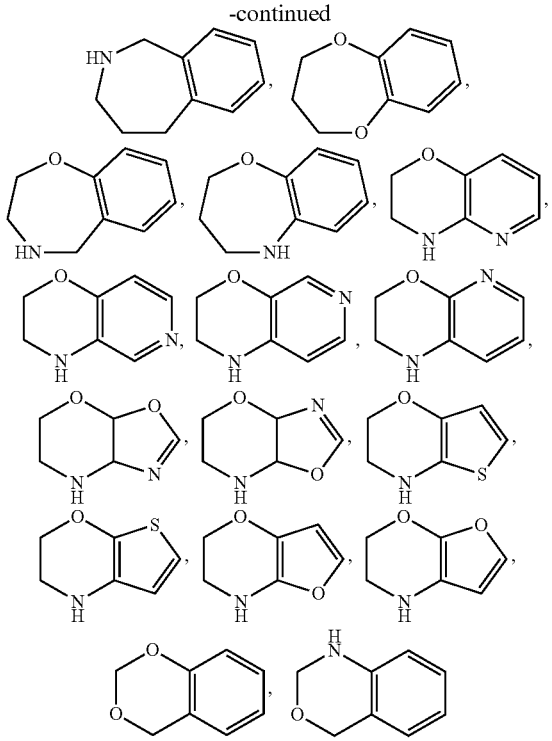

In other embodiments, the DP receptor antagonist is a non-toxic salt of one of the above compounds.

In other embodiments, the DP receptor antagonist is selected from the following compounds: (1) 1-(4-((2S)-4-methyl-3,4-dihydro-2H-1,4-benzoxazin-2-ylmethoxy)benzoyl)-2-methyl-1H-indol-4-ylacetic acid benzyl ester, (2) 1-(4-((2S)-4-methyl-3,4-dihydro-2H-1,4-benzoxazin-2-ylmethoxy)benzoyl)-2-methyl-1H-indol-4-yl acetic acid, (3) 1-(4-((2R)-1,4-benzodioxan-2-ylmethoxy)benzoyl)-2-methyl-1H-indol-4-yl acetic acid, (4) 1-(4-((2S)-1,4-benzodioxan-2-ylmethoxy)benzoyl)-2-methyl-1H-indole-4-yl acetic acid, (5) 1-(4-((2S)-1-methylindolin-2-ylmethoxy)benzoyl)-2-methyl-1H-indol-4-yl acetic acid, (6) 1-(4-((2R)-4-methyl-3,4-dihydro-2H-1,4-benzoxazin-2-ylmethoxy)benzoyl)-2-methyl-1H-indol-4-yl acetic acid, (7) 1-(4-((2S)-4,6-dimethyl-3,4-dihydro-2H-1,4-benzoxazin-2-ylmethoxy)benzoyl)-2-methyl-1H-indol-4-yl acetic acid, (8) 1-(4-((2S)-6-fluoro-4-methyl-3,4-dihydro-2H-1,4-benzoxazin-2-ylmethoxy)benzoyl)-2-methyl-1H-indol-4-yl acetic acid, (9) 1-(4-((2 S)-6-methoxy-4-methyl-3,4-dihydro-2H-1,4-benzoxazin-2-ylmethoxy)benzoyl)-2-methyl-1H-indol-4-yl acetic acid, (10) 1-(4-((2S)-7-methoxy-4-methyl-3,4-dihydro-2H-1,4-benzoxazin-2-ylmethoxy)benzoyl)-2-methyl-1H-indol-4-yl acetic acid, (11) 1-(4-((2S)-4,7-dimethyl-3,4-dihydro-2H-1,4-benzoxazin-2-ylmethoxy)benzoyl)-2-methyl-1H-indol-4-yl acetic acid, (12) 1-(4-((2S)-7-fluoro-4-methyl-3,4-dihydro-2H-1,4-benzoxazin-2-ylmethoxy)benzoyl)-2-methyl-1H-indol-4-yl acetic acid, (13) 1-(4-((2S)-1-ethylindolin-2-ylmethoxy)benzoyl)-2-methyl-1H-indol-4-yl acetic acid, (14) 1-(4-((2S)-4,8-dimethyl-3,4-dihydro-2H-1,4-benzoxazin-2-ylmethoxy)benzoyl)-2-methyl-1H-indol-4-yl acetic acid, (15) 1-(4-((2S)-5-methoxy-4-methyl-3,4-dihydro-2H-1,4-benzoxazin-2-ylmethoxy)benzoyl)-2-methyl-1H-indol-4-ylacetic acid, (16) 1-(4-((2S)-5-fluoro-4-methyl-3,4-dihydro-2H-1,4-benzoxazin-2-ylmethoxy)benzoyl)-2-methyl-1H-indol-4-yl acetic acid, (17) 1-(4-((2S)-2,3-dihydrobenzofuran-2-ylmethoxy)benzoyl)-2-methyl-1H-indol-4-yl acetic acid, (18) 1-(4-((2R)-2, 3-dihydrobenzofuran-2-ylmethoxy)benzoyl)-2-methyl-1H-indol-4-yl acetic acid, (19) 1-(4-((2 S)-8-fluoro-4-methyl-3,4-dihydro-2H-1,4-benzoxazin-2-ylmethoxy)benzoyl)-2-methyl-1H-indol-4-yl acetic acid, (20) 1-(4-((2R)-1,4-benzoxathian-2-ylmethoxy)benzoyl)-2-methyl-1H-indol-4-yl acetic acid, (21) 1-(4-((3S)-2,3-dihydrobenzofuran-3-ylmethoxy)benzoyl)-2-methyl-1H-indol-4-yl acetic acid, (22) 1-(4-((3R)-2,3-dihydrobenzofuran-3-ylmethoxy)benzoyl)-2-methyl-1H-indol-4-yl acetic acid, (23) 1-(4-((3R)-5-fluoro-2,3-dihydrobenzofuran-3-ylmethoxy)benzoyl)-2-methyl-1H-indol-4-ylacetic acid, (24) 1-(4-((3R)-5-methyl-2,3-dihydrobenzofuran-3-ylmethoxy)benzoyl)-2-methyl-1H-indol-4-yl acetic acid, (25) 1-(4-((3R)-6-fluoro-2,3-dihydrobenzofuran-3-ylmethoxy)benzoyl)-2-methyl-1H-indol-4-ylacetic acid, (26) 1-(4-((3R)-7-methyl-2,3-dihydrobenzofuran-3-ylmethoxy)benzoyl)-2-methyl-1H-indol-4-yl acetic acid, (27) 1-(4-((2R)-5-fluoro-1,4-benzodioxan-2-ylmethoxy)benzoyl)-2-methyl-1H-indol-4-yl acetic acid, (28) 1-(4-((2S)-8-fluoro-1,4-benzodioxan-2-ylmethoxy)benzoyl)-2-methyl-1H-indol-4-yl acetic acid, (29) 1-(4-((3R)-7-fluoro-2,3-dihydrobenzofuran-3-ylmethoxy)benzoyl)-2-methyl-1H-indol-4-yl acetic acid, (30) 3-(1-(4-((2S)-4-methyl-3,4-dihydro-2H-1,4-benzoxazin-2-ylmethoxy)benzoyl)-2-methyl-1H-indol-4-yl)acrylic acid allyl ester, (31) 3-(1-(4-((2S)-4-methyl-3,4-dihydro-2H-1,4-benzoxazin-2-ylmethoxy)benzoyl)-2-methyl-1H-indol-4-yl)acrylic acid, (32) 3-(1-(4-((2S)-4-methyl-3,4-dihydro-2H-1,4-benzoxazin-2-ylmethoxy)benzoyl)-2-methyl-1H-indol-4-yl)propanoic acid, (33) (1-(4-((2S)-4-methyl-3,4-dihydro-2H-1,4-benzoxazin-2-ylmethoxy)benzoyl)-2-methyl-1H-indol-4-yl)oxyacetic acid benzyl ester, (34) (1-(4-((2S)-4-methyl-3,4-dihydro-2H-1,4-benzoxazin-2-ylmethoxy)benzoyl)-2-methyl-1H-indol-4-yl)oxyacetic acid, (35) 1-(4-((2S)-4-methyl-3,4-dihydro-2H-1,4-benzoxazin-2-ylmethoxy)benzoyl)-2-methyl-1H-indol-4-carboxylic acid benzyl ester, (36) 1-(4-((2S)-4-methyl-3,4-dihydro-2H-1,4-benzoxazin-2-ylmethoxy)benzoyl)-2-methyl-1H-indol-4-carboxylic acid, (37) 1-(4-((2S)-4-methyl-3,4-dihydro-2H-1,4-benzoxazin-2-ylmethoxy)benzoyl)-1H-indol-4-yl acetic acid benzyl ester, (38) 1-(4-((2S)-4-methyl-3,4-dihydro-2H-1,4-benzoxazin-2-ylmethoxy)benzoyl)-1H-indol-4-yl acetic acid, (39) 1-(4-((2S)-4-methyl-3,4-dihydro-2H-1,4-benzoxazin-2-ylmethoxy)benzoyl)-2,3-dihydro-1H-indol-4-yl acetic acid, (40) 1-(4-((2S)-4-methyl-3,4-dihydro-2H-1,4-benzoxazin-2-ylmethoxy)benzoyl)-2-methyl-2,3-dihydro-1H-indol-4-ylacetic acid, (41) 2-(1-(4-((2S)-4-methyl-3,4-dihydro-2H-1,4-benzoxazin-2-ylmethoxy)benzoyl)-2-methyl-1H-indol-4-yl)ethanol, (42) 2-(1-(4-((2S)-4,6-dimethyl-3,4-dihydro-2H-1,4-benzoxazin-2-ylmethoxy)benzoyl)-2-methyl-1H-indol-4-yl)ethanol, (43) 2-(1-(4-((2S)-6-fluoro-4-methyl-3,4-dihydro-2H-1,4-benzoxazin-2-ylmethoxy)benzoyl)-2-methyl-1H-indol-4-yl)ethanol, (44) 2-(1-(4-((2S)-7-fluoro-4-methyl-3,4-dihydro-2H-1,4-benzoxazin-2-ylmethoxy)benzoyl)-2-methyl-1H-indol-4-yl)ethanol, (45) 2-(1-(4-((2S)-2,3-dihydrobenzofuran-2-ylmethoxy)benzoyl)-2-methyl-1H-indol-4-yl)ethanol, (46) 2-(1-(4-((3R)-2,3-dihydrobenzofuran-3-ylmethoxy)benzoyl)-2-methyl-1H-indol-4-yl)ethanol, (47) N-methylsulfonyl-(1-(4-((2S)-4-methyl-3,4-dihydro-2H-1,4-benzoxazin-2-ylmethoxy)benzoyl)-2-methyl-1H-indol-4-yl)acetamide, (48) N-phenylsulfonyl-(1-(4-((2S)-4-methyl-3,4-dihydro-2H-1,4-benzoxazin-2-ylmethoxy)benzoyl)-2-methyl-1H-indol-4-yl)acetamide, (49) 2-(1-(4-((2S)-4-methyl-3,4-dihydro-2H-1,4-benzoxazin-2-ylmethoxy)benzoyl)-2-methyl-1H-indol-4-yl)ethyl acetate, (50) 1-(4-((2 S)-4-methyl-3,4-dihydro-2H-1,4-benzoxazin-2-ylmethoxy)-2-methylbenzoyl)-2-methyl-1H-indol-4-yl acetic acid benzyl ester, (51) 1-(4-((2S)-4-methyl-3,4-dihydro-2H-1,4-benzoxazin-2-ylmethoxy)-2-methylbenzoyl)-1H-indol-4-yl acetic acid benzyl ester, (52) 1-(4-((2S)-4-methyl-3,4-dihydro-2H-1,4-benzoxazin-2-ylmethoxy)-2-methylbenzoyl)-2-methyl-1H-indol-4-yl acetic acid, and (53) 1-(4-((2S)-4-methyl-3,4-dihydro-2H-1,4-benzoxazin-2-ylmethoxy)-2-methylbenzoyl)-1H-indol-4-yl acetic acid or a non-toxic salt thereof.

In other embodiments, the DP receptor antagonist has the structure:

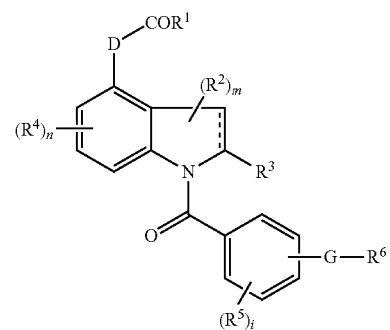

wherein $R^1$ represents hydroxy, C1-6 alkoxy, or $NR^8R^9$, in which $R^8$ and $R^9$ each independently represents a hydrogen atom, C1-6 alkyl, or $SO_2R^{13}$, in which $R^{13}$ represents C1-6 alkyl, a C3-15 saturated or unsaturated carbocyclic ring or a 4- to 15-membered heterocyclic ring containing 1 to 5 nitrogen atom(s), sulfur atom(s) and/or oxygen atom(s);

$R^2$ represents a hydrogen atom, C1-6 alkyl, C1-6 alkoxy, C2-6 alkoxyalkyl, a halogen atom, amino, trihalomethyl, cyano, hydroxy, benzyl, or 4-methoxybenzyl;

$R^3$ represents a hydrogen atom, C1-6 alkyl, C1-6 alkoxy, a halogen atom, trihalomethyl, cyano, or hydroxy;

$R^4$ and $R^5$ each independently represents a hydrogen atom, C1-6 alkyl, C1-6 alkoxy, C2-6 alkoxyalkyl, a halogen atom, nitro, amino, trihalomethyl, cyano, or hydroxy;

D represents a single bond, C1-6 alkylene, C2-6 alkenylene, or C1-6 oxyalkylene;

in --G--$R^6$,

1)
G represents a single bond, C1-6 alkylene which may be substituted with 1 to 2 oxygen atom(s) and/or sulfur atom(s), C2-6 alkenylene which may be substituted with 1 to 2 oxygen atom(s) and/or sulfur atom(s), in which the alkylene and the alkenylene may be substituted with hydroxy or C1-4 alkoxy, —C(O)NH—, —NHC(O)—, —SO$_2$NH—, —NHSO$_2$—, or diazo;

$R^6$ represents a C3-15 saturated or unsaturated carbocyclic ring, or a 4- to 15-membered heterocyclic ring containing 1 to 5 nitrogen atom(s), sulfur atom(s) and/or oxygen atom(s), in which the ring may be substituted with 1 to 5 substituent(s) selected from C1-6 alkyl, C1-10 alkoxy, C2-6 alkoxyalkyl, a halogen atom, hydroxy, trihalomethyl, nitro, amino, phenyl, phenoxy, oxo, C2-6 acyl, C1-6 alkanesulfonyl and cyano;

2) G and $R^6$ are taken together to represent
(i) C1-15 alkyl which may be substituted with 1 to 5 oxygen atom(s) and/or sulfur atom(s);

(ii) C2-15 alkenyl which may be substituted with 1 to 5 oxygen atom(s) and/or sulfur atom(s); or (iii) C2-15 alkynyl which may be substituted with 1 to 5 oxygen atom(s) and/or sulfur atom(s), in which the alkyl, the alkenyl and the alkynyl may be substituted with 1 to 12 substituent(s) selected from C1-6 alkoxy, a halogen atom, hydroxy, cyano, oxo and $NR^{11}R^{12}$, in which $R^{11}$ and $R^{12}$ each independently represents a hydrogen atom, C1-6 alkyl, C2-6 alkenyl, phenyl, benzoyl, naphthyl, phenyl substituted with C1-6 alkyl, or C1-6 alkyl substituted with phenyl or cyano;

n represents 1 to 3;
m represents 1 to 3;
i represents 1 to 4; and

----- represents a single bond or a double bond

In another embodiment, the DP receptor antagonist has one of the following structures:

Compound A
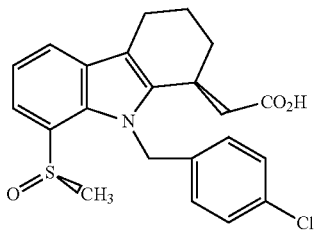

Compound B
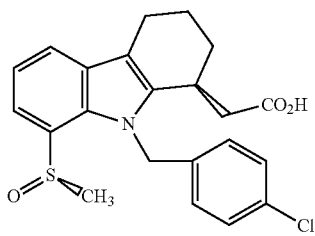

Compound C
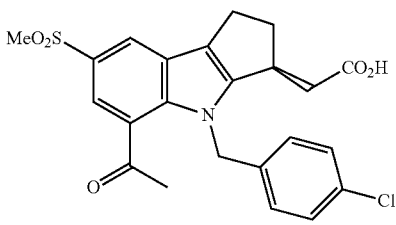

Compound D
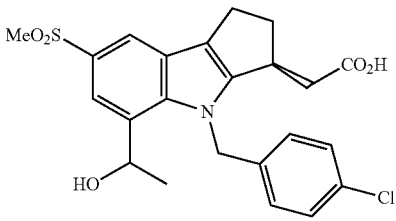

Compound E
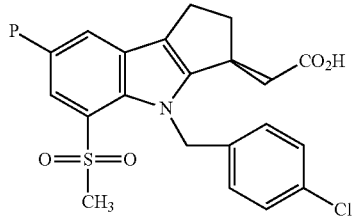

Compound F
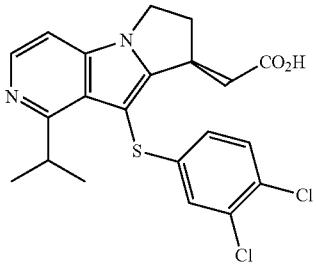

Compound G
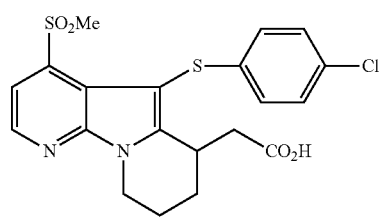

Compound H
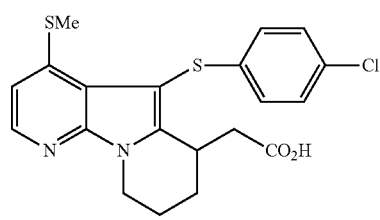

Compound I
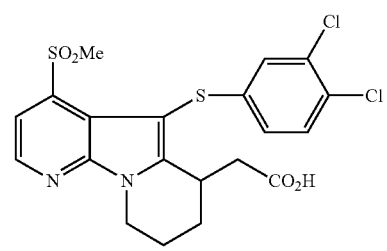

Compound J
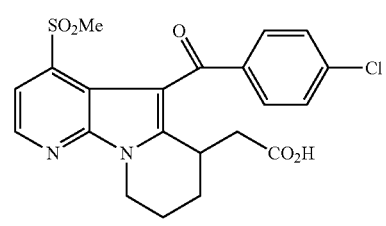

Compound K
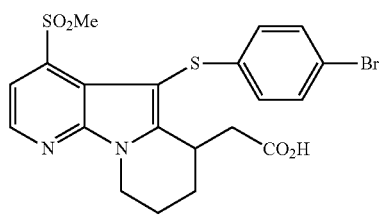

In another embodiment, the DP receptor antagonist has one of the following structures:

Compound L
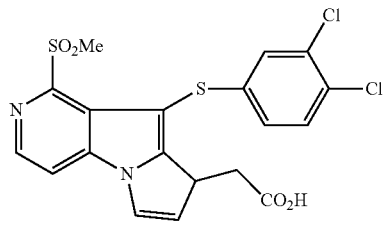
Compound M
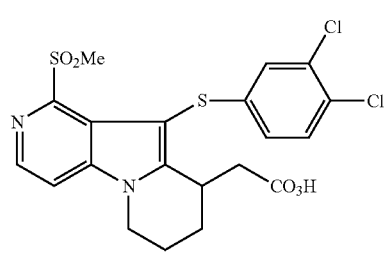
Compound N
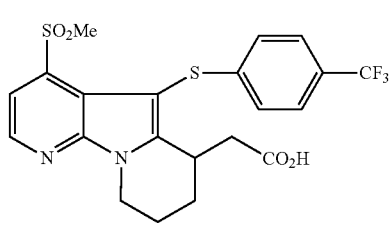
Compound O
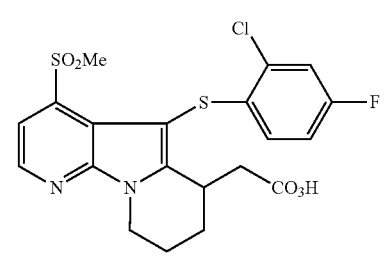
Compound P
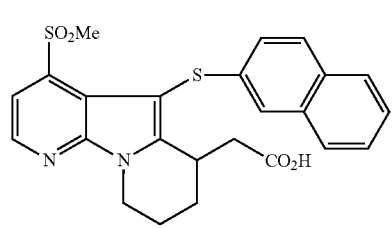
Compound Q
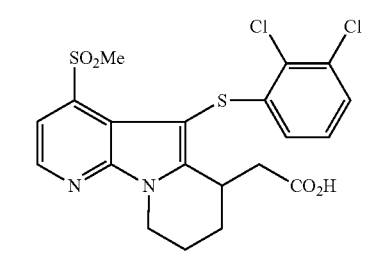
Compound R
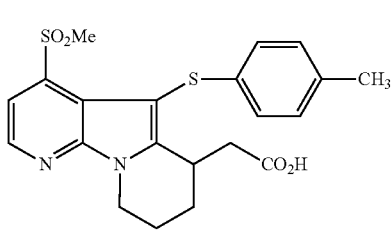
Compound S
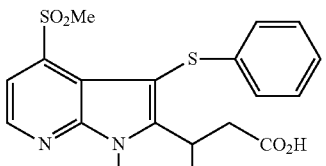
Compound T
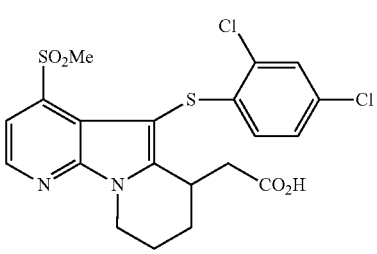
Compound U
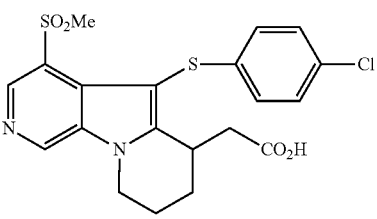
Compound V
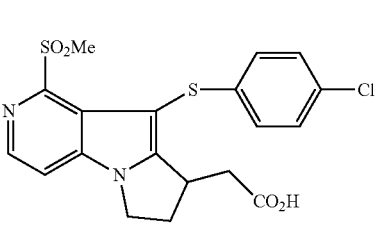
Compound W
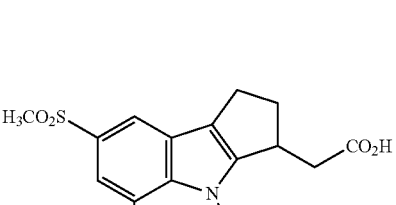
In another embodiment, the DP receptor antagonist has one of the following structures:
Compound X
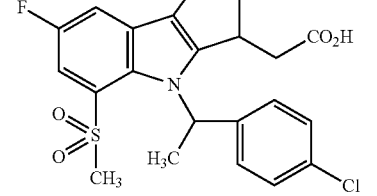

Compound Y
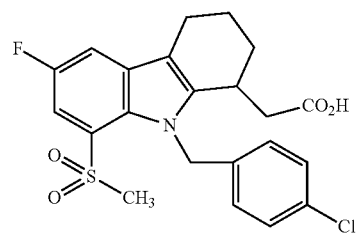
Compound Z
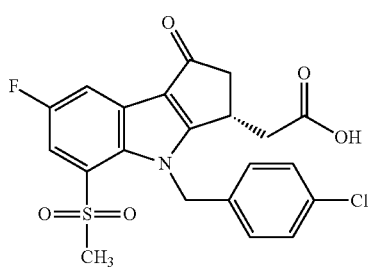
Comound AA
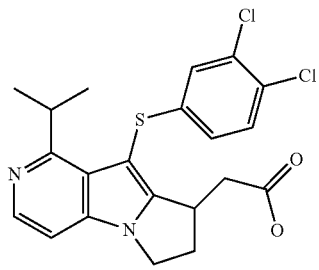
Compound AB
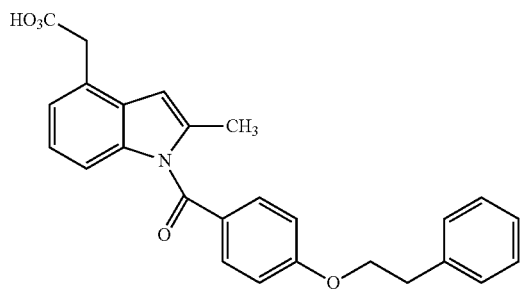
Compound AC
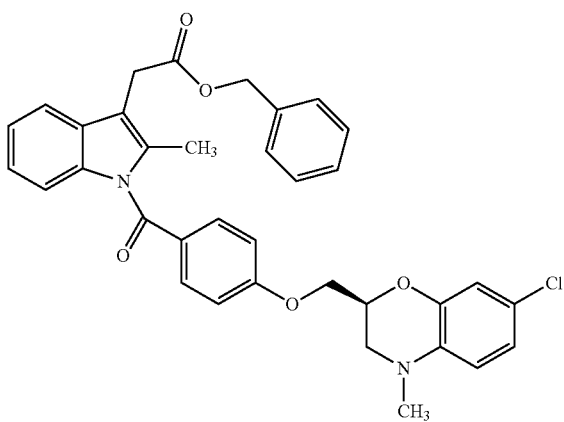
Compound AD
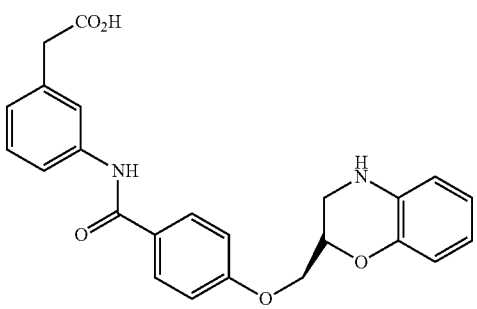
Compound AE
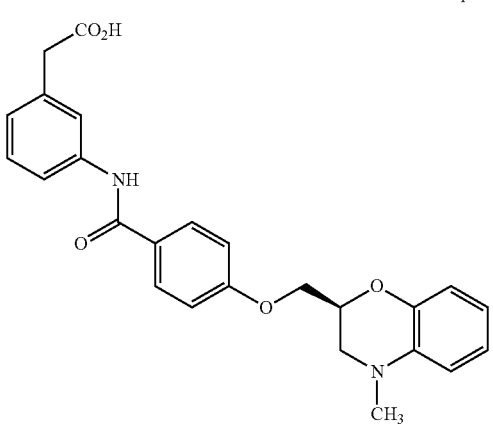
Compound AF
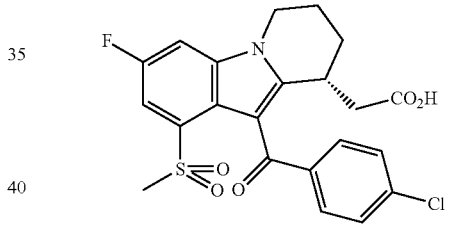
In another embodiment, the DP receptor antagonist has one of the following structures:
Compound AG
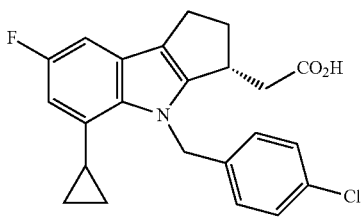
Compound AH
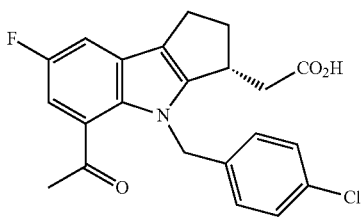

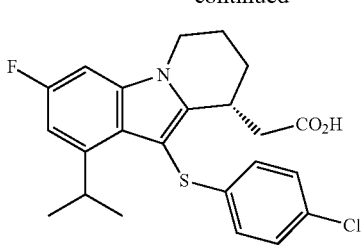

Compound AI

In another embodiment, the DP receptor antagonist has the following structure:

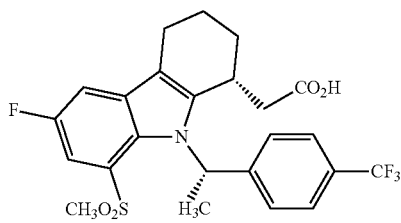

Compound AJ

In another embodiment, the DP receptor antagonist is [5-[(4-Chlorophenyl)thio]-4-(methylsulfonyl)-6,7,8,9-tetrahydropyrido[3,2-b]indolizin-6yl]acetic acid. In another embodiment, the DP receptor antagonist is [5-[(4-Chlorophenyl)thio]-4-(methylthio)-6,7,8,9-tetrahydropyrido[3,2-b]indolizin-6-yl]acetic acid. In another embodiment, the DP receptor antagonist is [5-[(3,4-Dichlorophenyl)thio]-4-(methylsulfonyl)-6,7,8,9-tetrahydropyrido[3,2-b]indolizin-6-yl]acetic acid. In another embodiment, the DP receptor antagonist is [5-(4-Chlorobenzoyl)-4-(methylsulfonyl)-6,7,8,9-tetrahydropyrido[3,2-b]indolizin-6-yl]acetic acid. In another embodiment, the DP receptor antagonist is [5-(4-Bromophenyl)thio]-4-(methylsulfonyl)-6,7,8,9-tetrahydropyrido[3,2-b]indolizin-6-yl]acetic acid. In another embodiment, the DP receptor antagonist is [9-[(3,4-Dichlorophenyl)thio]-1-(methylsulfonyl)-7,8-dihydro-6H-pyrido[3,4-b]pyrrolizin-8-yl]acetic acid. In another embodiment, the DP receptor antagonist is [10-[(3,4-Dichlorophenyl)sulfanyl]-1-(methylsulfonyl)-6,7, 8,9-tetrahydropyrido[3,4-b]indolizin-9-yl]acetic acid. In another embodiment, the DP receptor antagonist is (4-(Methylsulfonyl)-5-{[4-(trifluoromethyl)phenyl]thio}-6,7,8,9-tetrahydropyrido[3,2-b]indolizin-6-yl)acetic acid. In another embodiment, the DP receptor antagonist is [5-[(2-Chloro-4-fluorophenyl)thiol]-4-(methylsulfonyl)-6,7,8,9-tetrahydropyrido[3,2-b]indolizin-6-yl]acetic acid. In another embodiment, the DP receptor antagonist is [4-(Methylsulfonyl)-5-(2-naphthylthio)-6,7,8,9-tetrahydropyrido[3,2-b]indolizin-6-yl]acetic acid. In another embodiment, the DP receptor antagonist is [5-[(2,3-Dichlorophenyl)thio]-4-(methylsulfonyl)-6,7,8,9-tetrahydropyrido[3,2-b]indolizin-6-yl]acetic acid. In another embodiment, the DP receptor antagonist is [5-[(4-Methylphenyl)thiol]-4-(methylsulfonyl)-6,7,8,9-tetrahydropyrido[3,2-b]indolizin-6-yl]acetic acid. In another embodiment, the DP receptor antagonist is [4-(Methylsulfonyl)-5-(phenylthio)-6,7,8,9-tetrahydropyrido[3,2-b]indolizin-6-yl]acetic acid. In another embodiment, the DP receptor antagonist is [5-[(2,4-Dichlorophenyl)thiol-4-(methylsulfonyl)-6,7,8, 9-tetrahydropyrido[3,2-b]indolizin-6-yl]acetic acid. In another embodiment, the DP receptor antagonist is [5-[(4-Chlorophenyl)thio]-4-(methylsulfonyl)-6,7,8,9-tetrahydropyrido[4,3-b]indolizin-6-yl]acetic acid. In another embodiment, the DP receptor antagonist is [9-[(4-Chlorophenyl)thio]-1-(methylsulfonyl)-7,8-dihydro-6H-pyrido[3,4-b]pyrrolizin-8-yl]acetic acid. In another embodiment, the DP receptor antagonist is (−)-[(4-Chlorobenzyl)-7-fluoro-5-methanesulfonyl)-1,2,3,4-tetrahydrocyclopenta[b]indol-3-yl]acetic acid. In another embodiment, the DP receptor antagonist is (±)-}4-[1-(4-Chlorophenyl)ethyl]-7-fluoro-5-methanesulfonyl-1,2,3,4-tetrahydrocyclopenta[b]indol-3-yl}acetic acid In another embodiment, the DP receptor antagonist is (±)-[9-(4-Chlorobenzyl)-6-fluoro-methanesulfonyl-2,3,4,9-tetrahydro-1H-carbazol-1-yl]acetic acid. In another embodiment, the DP receptor antagonist is [4-(4-Chlorobenzyl)-7-fluoro-5-methanesulfonyl-1-oxo-1,2,3,4-tetrahydrocyclopenta[b]indol-3-yl]acetic acid. In another embodiment, the DP receptor antagonist is {9-[(3,4-Dichlorophenyl)thio]-1-isopropyl-7,8-dihydro-6H-pyrido[3,4-b]pyrrolizin-8-yl}acetic acid, Enantiomer A. In another embodiment, the DP receptor antagonist is {9-[(3,4-Dichlorophenyl)thio]-1-isopropyl-7,8-dihydro-6H-pyrido[3,4-b]pyrrolizin-8-yl}acetic acid, Enantiomer B. In another embodiment, the DP receptor antagonist is ((1R)-6-Fluoro-8-(methylsulfonyl)-9-{(1S)-1-[4-(trifluoromethyl)phenyl]ethyl}-2,3,4,9-tetrahydro-1H-carbazol-1-yl)acetic acid. Each possibility represents a separate embodiment of the present invention.

In other embodiments, the DP receptor antagonist is a non-toxic salt of one of the above compounds.

Methods for synthesizing the above DP receptor antagonists are well known in the art, and are described, for example, in the following patent applications: WO03/062200, published on Jul. 31, 2003; WO01/66520, published on Sep. 13, 2001; WO03/022814, published on Mar. 20, 2003; and WO03/078409, published on Sep. 25, 2003.

Each method of synthesis of a DP receptor antagonist represents a separate embodiment of the present invention.

In another embodiment, the DP receptor antagonist is a pharmaceutically acceptable salt of one of the above DP receptor antagonists. In another embodiment, the DP receptor antagonist is a related compound with DP receptor antagonist activity.

In another embodiment, the DP receptor antagonist is any other DP receptor antagonist known in the art Each DP receptor antagonist and DP-1 antagonist represents a separate embodiment of the present invention. Each substituent in each moiety indicated above as having different possible substituents represents a separate embodiment of the present invention. Each position in each moiety indicated above as having different possible positions represents a separate embodiment of the present invention.

The DP receptor that is inhibited by methods and compositions of the present invention has, in another embodiment, the sequence:

(SEQ ID No: 268)
MKSPFYRCQNTTSVEKGNSAVMGGVLFSTGLLGNLLALGLLARSGLGWCS

RRPLRPLPSVFYMLVCGLTVTDLLGKCLLSPVVLAAYAQNRSLRVLAPAL

DNSLCQAFAFFMSFFGLSSTLQLLAMALECWLSLGHPFFYRRHITLRLGA

LVAPVVSAFSLAFCALPFMGFGKFVQYCPGTWCFIQMVHEEGSLSVLGYS

VLYSSLMALLVLATVLCNLGAMRNLYAMHRRLQRHPRSCTRDCAEPRADG

REASPQPLEELDHLLLLALMTVLFTMCSLPVIYRAYYGAFKDVKEKNRTS

EEAEDLRALRFLSVISIVDPWIFIIFRSPVFRIFFHKIFIRPLRYRSRCS NSTNMESSL.

In another embodiment, the DP receptor is a homologue of SEQ ID No: 268. In another embodiment, the DP receptor is a variant of SEQ ID No: 268. In another embodiment, the DP receptor is an isomer of SEQ ID No: 268. In another embodiment, the DP receptor is a fragment of SEQ ID No: 268. In another embodiment, the DP receptor comprises SEQ ID No: 268. Each possibility represents a separate embodiment of the present invention.

In another embodiment, the DP receptor is encoded by a nucleotide sequence having the sequence:

(SEQ ID No: 269)
cgcccgagccgcgcgcggagctgccgggggctccttagcacccgggcgcc gggcccctcgcccttccgcagccttcactccagccctctgctcccgcacg ccatgaagtcgccgttctaccgctgccagaacaccacctctgtggaaaaa ggcaactcggcggtgatgggcggggtgctcttcagcaccggcctcctggg caacctgctggccctggggctgctggcgcgctcggggctggggtggtgct cgcggcgtccactgcgcccgctgccctcggtcttctacatgctggtgtgt ggcctgacggtcaccgacttgctgggcaagtgcctcctaagcccggtggt gctggctgcctacgctcagaaccggagtctgcgggtgcttgcgcccgcat tggacaactcgttgtgccaagccttcgccttcttcatgtccttctttggg ctctcctcgacactgcaactcctggccatggcactggagtgctggctctc cctagggcacccttcttctaccgacggcacatcaccctgcgcctgggcg cactggtggcccgtggtgagcgccttctccctggctttctgcgcgcta cctttcatgggcttcgggaagttcgtgcagtactgccccggcacctggtg ctttatccagatggtccacgaggagggctcgctgtcggtgctggggtact ctgtgctctactccagcctcatggcgctgctggtcctcgccaccgtgctg tgcaacctcggcgccatgcgcaacctctatgcgatgcaccggcggctgca gcggcacccgcgctcctgcaccagggactgtgccgagccgcgcgcggacg ggagggaagcgtcccctcagccctggaggagctggatcacctcctgctg ctggcgctgatgaccgtgctcttcactatgtgttctctgcccgtaattta tcgcgcttactatggagcatttaaggatgtcaaggagaaaaacaggacct ctgaagaagcagaagacctccgagccttgcgatttctatctgtgatttca attgtggaccccttggattttttatcattttcagatctccagtatttcggat atttttttcacaagattttcattagacctcttaggtacaggagccggtgca gcaattccactaacatggaatccagtctgtgacagtgttttcactctgt ggtaagctgaggaatatgtcacattttcagtcaaagaaccatgattaaaa aaaaaagacaacttacaatttaaatccttaaaagttacctcccataaca aaagcatgtatatgtattttcaaaagtatttgatatcttaacaatgtgtt accattctatgtcatgaacccttcagtgcattttcattttttttattaa cagcaactaaaatttatatattgtaaccagtgttaaaagtcttaaaaaa caatggtattaattgtccctacatttgtgcttggtggccctattttttt ttttagagaggccttgagacatacaggtcttttaaaatacagtagaaaca ccactgtttacgattatacgatggacattcataaaaagcataatttctta ccctattcattttttggtgaaacctgattcattgattttatatcattgcc gatgtttagttcatttctttgccaattgatctaagcatagcctgaattat gatgttcctcagaaagtgaggtgggaaatatgaccaggtcaggcagttgg aggggcttccccagccaccatcggggagtacttgctgcctcaggtggaga cctgaagctgtaactagatgcagagcaagatatgactatagcccacaacc caaagaagcaaaaattcgttttatctttttgaaatccagtttctttttgta ttgagtcaagggtgtcagtaggaatcaaaagttgggggtgggttgcaaaa tgttctttcagttttttagaacctccattttataaaagaattatcctatca atggattctttagtggaaggatttatgcttctttgaaaaccagtgtgtga ctcactgtagagccatgtttactgtttgactgtgtggcacaggggggcat ttggcacagcaaaaagcccacccaggacttagcctcagttgacgatagta acaatggccttaacatctaccttaacagctacctattacagccgtattct gctgtccgtggagacggtaagatcttaggttccaagattttacttcaaat tacaccttcaaaactggagcagcatatagccgaaaaggagcacaactgag cactttaatagtaatttaaaagttttcaagggtcagcaatatgatgactg aaagggaaaagtggaggaaacgcagctgcaactgaagcggagactctaaa cccagcttgcaggtaagagctttcacctttggtaaaagaacagctgggga ggttcaaggggtttcagcatctctggagttccttgtatctgacaatctc aggactccaaggtgcaaagcctgctgcatttgcgtgatctcaagacctcc agccagaagtcccttccaaatataagagtactcatgtttatttatttcca actgagcagcaacctccttgtttcacttatgttttttccagtatctgag ataatataaagctgggtaatttttatgtaattttttggtatagcaaaac tgtgaaaagccaaattaggcataccaaggagtatgatttaacagtatgac atgatgaaaaaatacagttgttttttgaaattttaacttttgtttgtacct tcaatgtgtaagtacatgcatgttttattgtcagaggaagaacatgtttt ttgtattctttttttggagaggtgtgttaggataattgtccagttaattt gaaaaggcccagatgaatcaataaatataattttatagtaaaaaaaaaa aaaaaaaaaaaaaaa.

In another embodiment, the DP receptor is encoded by a nucleotide molecule that a homologue of SEQ ID No: 269. In another embodiment, the nucleotide molecule is a variant of SEQ ID No: 269. In another embodiment, the nucleotide molecule is an isomer of SEQ ID No: 269. In another embodiment, the nucleotide molecule is a fragment of SEQ ID No: 269. In another embodiment, the nucleotide molecule comprises SEQ ID No: 269. Each possibility represents a separate embodiment of the present invention.

In another embodiment, the DP receptor has an AA sequence set forth in one of the following GenBank entries: BC040968, AK026202, and U31099. In another embodiment, the DP receptor has a nucleotide sequence set forth in one of the above GenBank entries. In another embodiment, the DP receptor is a homologue of a sequence set forth in one of the above GenBank entries. In another embodiment, the DP receptor is a variant of a sequence set forth in one of the above GenBank entries. In another embodiment, the DP receptor is an isomer of a sequence set forth in one of the above GenBank entries. In another embodiment, the DP receptor is a fragment of a sequence set forth in one of the above GenBank entries. In another embodiment, the DP receptor comprises a sequence set forth in one of the above GenBank entries. Each possibility represents a separate embodiment of the present invention.

In another embodiment, a DP-2 receptor antagonist is utilized in methods and compositions of the present invention. In another embodiment, the antagonist is any DP-2 antagonist known in the art. Each possibility represents a separate embodiment of the present invention.

In another embodiment, a method of the present invention comprises the use of a prostaglandin antagonist. In another embodiment, the prostaglandin antagonist has the formula:

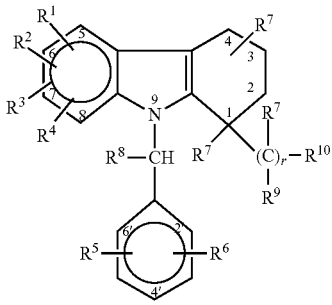

wherein:

R1, $R^2$, $R^3$, $R^4$, $R^5$ and $R^6$ are each independently selected from:

(1) hydrogen; (2) alkyl having 1 to 6 carbon atoms; (3) alkenyl having 2 to 6 carbon atoms; (4) —$(CH_2)_n$ M, wherein n is 0 to 3 and M is (a) $OR^{13}$; (b) halogen; (c) $CF_3$; (d) $SR^{13}$; (e) phenyl or substituted phenyl, wherein substituted phenyl is as defined below in the definition of $R^{13}$; (f) $COOR^{14}$; (g)

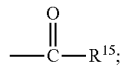

(h) tetrazole; (i)

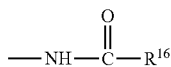

wherein $R^{16}$ is $C_1$ to $C_6$ alkyl, benzyl or phenyl; (j) —$NR^{14}R^{14}$; (k) —$NHSO_2 R^{17}$, wherein $R^{17}$ is $C_1$ to $C_6$ alkyl, 4-methylphenyl, phenyl, or $CF_3$; (l)

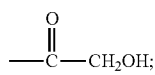

(m) —$SOR^{13}$; (n) —$CONR^{14}R^{14}$; (o) —$SO_2 NR^{14}R^{14}$; (p) —$SO_2 R^{13}$; (q) $NO_2$; (r)

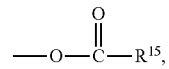

(s)

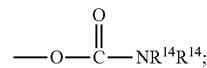

(t)

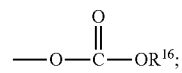

(v) $N_3$; and (u) CN;

$R^7$ is H or alkyl of 1 to 6 carbons;

$R^8$ is H or alkyl of 1 to 6 carbon atoms;

each $R^9$ is independently H, OH, $C_1$ to $C_4$-O-alkyl or alkyl of 1 to 4 carbons;

$R^{10}$ is COOH; $CH_2$ OH; CHO; tetrazole; $NHSO_2 R^{11}$ wherein $R^{11}$ is OH, alkyl or alkoxy of 1 to 6 carbons, perhaloalkyl of 1 to 6 carbons, phenyl or phenyl substituted by alkyl or alkoxy groups of 1 to 3 carbons, halogen, hydroxy, COOH, CN, formyl or acyl to 1 to 6 carbons; $CONHSO_2 R^{11}$, hydroxymethylketone; CN; or $CON(R^9)_2$;

r is 1 to 6;

each $R^{13}$ independently is H; $C_1$ to $C_6$ alkyl; benzyl, phenyl or substituted phenyl wherein the substituents are $C_1$ to $C_3$ alkyl, halogen, CN, $CF_3$, $COOR^{14}$, $CH_2 COOR^{14}$, $C_1$ to $C_3$ alkoxy, or $C_1$ to $C_4$ perfluoroalkyl;

each $R^{14}$ is independently H, phenyl, benzyl or $C_1$ to $C_6$ alkyl; and each $R^{15}$ independently is H, $(CH_2)_m COOR^{14}$ wherein m is 0 to 4, $C_1$ to $C_6$ alkyl, $CF_3$, phenyl, or substituted phenyl wherein substituted phenyl is as defined above in the definition of $R^{13}$.

In another embodiment, the prostaglandin antagonist is a pharmaceutically acceptable salt of one of the above prostaglandin antagonists. In another embodiment, the prostaglandin antagonist is a compound with prostaglandin antagonist activity, related to one of the above structures. In another embodiment, the prostaglandin antagonist is any other prostaglandin antagonist known in the art.

Each prostaglandin antagonist represents a separate embodiment of the present invention.

In another embodiment, the present invention provides a method of treating baldness in a scalp of a subject, comprising the step of contacting the subject or the scalp thereof with a compound or composition capable of decreasing a level of a prostaglandin D2, thereby treating baldness in a scalp of a subject. In another embodiment, the baldness is mediated by an AGA. In another embodiment, the compound or composition decreases the prostaglandin D2 level in the target scalp. Each possibility represents a separate embodiment of the present invention.

In another embodiment, the present invention provides a method of treating baldness in a scalp of a subject, comprising the step of contacting the subject or the scalp thereof with a compound or composition capable of inhibiting accumulation of a prostaglandin D2, thereby treating baldness in a scalp of a subject. In another embodiment, the baldness is mediated by an AGA. In another embodiment, the compound or composition inhibits accumulation of the prostaglandin D2 level in the target scalp. Each possibility represents a separate embodiment of the present invention.

In another embodiment, the compound or composition is 2-(2'-benzothiazolyl)-5-styryl-3-(4'-phthalhydrazidyl) tetrazolium chloride (BSPT). In another embodiment, the compound or composition is any other PGD2S inhibitor known in the art. In another embodiment, the compound or composition inhibits brain type PGD2S. In another embodiment, the compound or composition inhibits hematopoietic type PGD2S. In another embodiment, the compound or composition inhibits both PGD2S types. In another embodiment, the compound or composition functions by any other means known in the art of inhibiting a PGD2S activity. Each possibility represents a separate embodiment of the present invention.

In another embodiment, the compound acts upstream of PGD2S. In another embodiment, the compound inhibits early arachadonic acid metabolism. In another embodiment, the compound inhibits conversion of arachidonic acid to prostaglandin H2. In another embodiment, the compound or composition functions by inhibiting an activity of a cyclooxygenase (COX) enzyme. In another embodiment, the compound or composition inhibits a COX-1 enzyme. In another embodiment, the compound or composition inhibits a COX-2 enzyme. In another embodiment, the compound or composition inhibits both COX-1 and COX-2 enzymes. In another embodiment, the compound is a non-steroidal anti-inflammatory drug (NSAID). In another embodiment, the NSAID is SOLARAZE® (diclofenac topical). In another embodiment, the NSAID is any other NSAID known in the art. In another embodiment, the compound is a pgh2 analogue. In another embodiment, the compound or composition functions by any other means known in the art of decreasing prostaglandin D2 levels. Each possibility represents a separate embodiment of the present invention.

In another embodiment, a topical NSAID used in methods and compositions of the present invention inhibits PGD2. In another embodiment, the NSAID, in addition to inhibiting PGD2, inhibits a pro-hair growth prostaglandin. In another embodiment, the NSAID is administered in conjunction with a pro-hair growth prostaglandin. In another embodiment, supplementation with a pro-hair growth prostaglandin inhibits anti-hair growth side effects of the NSAID. In another embodiment, the pro-hair growth prostaglandin is pge. In another embodiment, the pro-hair growth prostaglandin is a compound related to pge. In another embodiment, the pro-hair growth prostaglandin is pgf. In another embodiment, the pro-hair growth prostaglandin is a compound related to pgf. In another embodiment, the pro-hair growth prostaglandin is any other pro-hair growth prostaglandin known in the art. Each possibility represents a separate embodiment of the present invention.

The COX enzyme that is the target of methods and compositions of the present invention is, in another embodiment, a prostaglandin-endoperoxide synthase 2 (prostaglandin G/H synthase and cyclooxygenase) (a.k.a.PTGS2) enzyme. In another embodiment, the COX enzyme is a COX-2 (COX2) enzyme. In another embodiment, the COX enzyme is a PGG/HS enzyme. In another embodiment, the COX enzyme is a PGHS-2 enzyme. PGHS-2 is, in another embodiment, a precursor of PGD2. In another embodiment, the COX enzyme is a PHS-2 enzyme. In another embodiment, the COX enzyme is a hCox-2 enzyme.

In another embodiment, the sequence of the target COX-2 enzyme is:

(SEQ ID No: 273; GenBank Accession No. NM_004878)
MPAHSLVMSSPALPAFLLCSTLLVIKMYVVAIITGQVRLRKKAFANPEDA

LRHGGPQYCRSDPDVERCLRAHRNDMETIYPFLFLGFVYSFLGPNPFVAW

MHFLVFLVGRVAHTVAYLGKLRAPIRSVTYTLAQLPCASMALQILWEAAR

HL.

GenBank Accession No. NM_004878). In another embodiment, the COX-2 enzyme is a homologue of SEQ ID No: 273. In another embodiment, the COX-2 enzyme is a variant of SEQ ID No: 273. In another embodiment, the COX-2 enzyme is an isomer of SEQ ID No: 273. In another embodiment, the COX-2 enzyme is a fragment of the protein having a sequence set forth in SEQ ID No: 273. Each possibility represents another embodiment of the present invention.

In another embodiment, the COX-2 enzyme has an amino acid (AA) sequence set forth in one of the following GenBank entries: NM_000963, BC013734, AJ634912, M90100. In another embodiment, the COX-2 enzyme has a nucleotide sequence set forth in one of the above GenBank entries. In another embodiment, the COX-2 enzyme has a nucleotide or AA sequence set forth in a GenBank entry for a beta-trace protein. In another embodiment, the COX-2 enzyme has a nucleotide or AA sequence set forth in a GenBank entry for a prostaglandin-H2 D-isomerase protein. In another embodiment, the COX-2 enzyme has a nucleotide or AA sequence set forth in a GenBank entry for a glutathione-independent PGD synthase protein. In another embodiment, the COX-2 enzyme is a homologue of a sequence set forth in one of the above GenBank entries. In another embodiment, the COX-2 enzyme is a variant of a sequence set forth in one of the above GenBank entries. In another embodiment, the COX-2 enzyme is an isomer of a sequence set forth in one of the above GenBank entries. In another embodiment, the COX-2 enzyme is a fragment of a sequence set forth in one of the above GenBank entries. In another embodiment, the COX-2 enzyme comprises a sequence set forth in one of the above GenBank entries. Each possibility represents a separate embodiment of the present invention.

In another embodiment, the COX enzyme is a prostaglandin-endoperoxide synthase 1 (prostaglandin G/H synthase and cyclooxygenase) (a.k.a. PTGS1) enzyme. In another embodiment, the COX enzyme is a COX1 enzyme. In another embodiment, the COX enzyme is a COX3 enzyme. In another embodiment, the COX enzyme is a PCOX1 enzyme. In another embodiment, the COX enzyme is a PGG/HS enzyme. In another embodiment, the COX enzyme is a PGHS-1 enzyme. In another embodiment, the COX enzyme is a PGHS1 enzyme. In another embodiment, the COX enzyme is a PHS1 enzyme. In another embodiment, the COX enzyme is a PTGHS enzyme.

In another embodiment, the sequence of the target COX-1 enzyme is:

(SEQ ID No: 272; GenBank Accession No. NM_080591)
MSRSLLLWFLLFLLLLPPLPVLLADPGAPTPVNPCCYYPCQHQGICVRFG

LDRYQCDCTRTGYSGPNCTIPGLWTWLRNSLRPSPSFTHFLLTHGRWFWE

FVNATFIREMLMRLVLTVRSNLIPSPPTYNSAHDYISWESFSNVSYYTRI

LPSVPKDCPTPMGTKGKKQLPDAQLLARRFLLRRKFIPDPQGTNLMFAFF

-continued

```
AQHFTHQFFKTSGKMGPGFTKALGHGVDLGHIYGDNLERQYQLRLFKDGK

LKYQVLDGEMYPPSVEEAPVLMHYPRGIPPQSQMAVGQEVFGLLPGLMLY

ATLWLREHNRVCDLLKAEHPTWGDEQLFQTTRLILIGETIKIVIEEYVQQ

LSGYFLQLKFDPELLFGVQFQYRNRLAMEFNHLYHWHPLMPDSFKIGGGR

NMDHHILHVAVDVIRESREMRLQPFNEYRKRFGMKPYTSFQELVGEKEMA

AELEELYGDIDALEFYPGLLLEKCHPNSIFGESMIEIGAPFSLKGLLGNP

ICSPEYWKPSTFGGEVGFNIVKTATLKKLVCLNTKTCPYVSFRVPDASQD

DGPAVERPSTEL.
```

In another embodiment, the COX-1 enzyme is a homologue of SEQ ID No: 272. In another embodiment, the COX-1 enzyme is a variant of SEQ ID No: 272. In another embodiment, the COX-1 enzyme is an isomer of SEQ ID No: 272. In another embodiment, the COX-1 enzyme is a fragment of the protein having a sequence set forth in SEQ ID No: 272. Each possibility represents another embodiment of the present invention.

In another embodiment, the COX-1 enzyme has an AA sequence set forth in one of the following GenBank entries: NM_000962, DQ180742, DQ180741, and DQ180740. In another embodiment, the COX-1 enzyme has a nucleotide sequence set forth in one of the above GenBank entries. In another embodiment, the COX-1 enzyme has a nucleotide or AA sequence set forth in a GenBank entry for a beta-trace protein. In another embodiment, the COX-1 enzyme has a nucleotide or AA sequence set forth in a GenBank entry for a prostaglandin-H2 D-isomerase protein. In another embodiment, the COX-1 enzyme has a nucleotide or AA sequence set forth in a GenBank entry for a glutathione-independent PGD synthase protein. In another embodiment, the COX-1 enzyme is a homologue of a sequence set forth in one of the above GenBank entries. In another embodiment, the COX-1 enzyme is a variant of a sequence set forth in one of the above GenBank entries. In another embodiment, the COX-1 enzyme is an isomer of a sequence set forth in one of the above GenBank entries. In another embodiment, the COX-1 enzyme is a fragment of a sequence set forth in one of the above GenBank entries. In another embodiment, the COX-1 enzyme comprises a sequence set forth in one of the above GenBank entries. Each possibility represents a separate embodiment of the present invention.

In another embodiment, a method of the present invention functions by reducing the amount of PGHS-2 in a subject.

In another embodiment, demonstration in the present invention of up-regulation of the brain (lipocalin) form of PGD2S does not reflect the presence of mast cells (which express, in another embodiment, a distinct isoform of PGD2S). Rather, this finding identifies a separate mechanism for AGA. In another embodiment, both brain and hematopoietic forms are up-regulated.

In another embodiment, the present invention provides a method of treating baldness in a scalp of a subject, comprising the step of contacting the subject or the scalp thereof with a compound or composition capable of inhibiting an activity of a prostaglandin D2 synthase (PGD2S) enzyme, thereby treating baldness in a scalp of a subject. In another embodiment, the baldness is mediated by an AGA. In another embodiment, the compound or composition inhibits the prostaglandin D2 synthase activity in the target scalp. In another embodiment, inhibiting PGD2S activity results in a decrease of prostaglandin D2 levels. Each possibility represents a separate embodiment of the present invention.

In another embodiment, the PGD2S inhibitor is indomethacin. In another embodiment, the PGD2S inhibitor is a tetravalent selenium compound. In another embodiment, the PGD2S inhibitor is HQL-79. In another embodiment, the PGD2S inhibitor is specific for lipocalin PGD2S. In another embodiment, the PGD2S inhibitor inhibits more than 1 isoform of PGD2S. In another embodiment, the present invention utilizes a PGD2S inhibitor used to treat allergies. In another embodiment, the present invention utilizes a PGD2S inhibitor used to treat asthma. In another embodiment, the present invention utilizes a PGD2S inhibitor used to inhibit sleep.

In another embodiment, the PGD2S inhibitor has the structure:

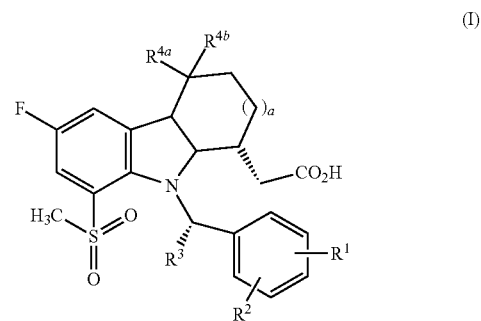

(I)

wherein n is 0 or 1; $R^1$ is hydrogen or halogen; $R^2$ is halogen, cyano, $C_{1-3}$ alkylsulfonyl or trifluoromethyl; $R^3$ is $C_{1-3}$ alkyl optionally substituted with 15 halogen atoms; and $R^{4a}$ and $R^{4b}$ are each hydrogen or one is hydrogen and the other is hydroxy, or both together represent oxo; with the proviso that when $R^1$ is hydrogen, $R^2$ is not 4-chloro.

In one embodiment of formula I are compounds wherein $R^{4a}$ and $R^{4b}$ are each hydrogen.

In a second embodiment of formula I are compounds wherein $R^1$ is hydrogen and $R^2$ is trifluoromethyl.

In a third embodiment of formula I are compounds wherein $R^3$ is methyl.

In a fourth embodiment of formula I are compounds wherein $R^1$ and $R^2$ are independently a halogen atom.

In a fifth embodiment of formula I are compounds wherein n is 1.

In a sixth embodiment of formula I are compounds wherein n is 1, $R^3$ is $CH_3$, and $R^{4a}$ and $R^{4b}$ are each hydrogen.

In a seventh embodiment of formula I are compounds wherein n is 1, $R^3$ is $CH_2F$ or $CHF_2$, and $R^{4a}$ and $R^{4b}$ are each hydrogen.

In an eighth embodiment of formula I are compounds wherein n is 1, $R^1$ is hydrogen, $R^3$ is methyl, $R^{4a}$ and $R^{4b}$ are each hydrogen, and $R^2$ is 4-cyano, 4-methanesulfonyl or 4-trifluoromethyl.

In another embodiment, the PGD2S inhibitor is ((1R)-6-fluoro-8-(methylsulfonyl)-9-{(1S)-1-[4-(trifluoromethyl)phenyl]ethyl}-2,3,4,9-tetrahydro-1H-carbazol-1-yl)acetic acid. In another embodiment, the PGD2S inhibitor is [(1R)-9-[(1S)-1-(3,4-dichlorophenyl)ethyl]-6-fluoro-8-(methylsulfonyl)-2,3,4,9-tetrahydro-1H-carbazol-1-yl]acetic acid. In another embodiment, the PGD2S inhibitor is {(1R)-6-fluoro-8-(methylsulfonyl)-9-[(1S)-1-phenylethyl]-2,3,4,9-tetrahydro-1H-carbazol-1-yl}acetic acid. In another embodiment, the PGD2S inhibitor is [(1R)-6-fluoro-9-[(1S)-1-(4-fluorophenyl)ethyl]-8-(methylsulfonyl)-2,3,4,9-tetrahydro-1H-carbazol-1-yl]acetic acid. In another embodiment, the PGD2S inhibitor is [(1R)-9-[(1S)-1-(4-chloro-3-fluorophenyl)ethyl]-6-fluoro-8-(methylsulfonyl)-2,3,4,9-tetrahydro-1H-carbazol-1-yl]acetic acid. In another embodiment, the PGD2S inhibitor is [(1R)-9-[(1S)-1-(3-chlorophenyl)ethyl]-6-fluoro-8-(methylsulfonyl)-2,3,4,9-tetrahydro-1H-carbazol-1-yl]acetic acid. In another embodiment, the PGD2S inhibitor is [(1R)-9-[(1S)-1-(4-chloro-2-fluorophenyl)ethyl]-6-fluoro-8-(methylsulfonyl)-2,3,4,9-tetrahydro-1H-carbazol-1-yl]acetic acid. In another embodiment, the PGD2S inhibitor is [(1R)-9-[(1S)-1-(4-bromophenyl)ethyl]-6-fluoro-8-(methylsulfonyl)-2,3,4,9-tetrahydro-1H-carbazol-1-yl]acetic acid. In another embodiment, the PGD2S inhibitor is [(1R)-9-[(1S)-1-(4-cyanophenyl)ethyl]-6-fluoro-8-(methylsulfonyl)-2,3,4,9-tetrahydro-1H-carbazol-1-yl]acetic acid. In another embodiment, the PGD2S inhibitor is ((1R)-6-fluoro-8-(methylsulfonyl)-9-{((1 S)-1-[4-(methylsulfonyl)phenyl]ethyl}-2,3,4,9-tetrahydro-1H-carbazol-1-yl)acetic acid. In another embodiment, the PGD2S inhibitor is (1R)-1-[4-(trifluoromethyl)phenyl]ethanol. In another embodiment, the PGD2S inhibitor is 1-(4-chloro-2-fluorophenyl)ethanone. In another embodiment, the PGD2S inhibitor is 1-(4-chloro-3-fluorophenyl)ethanone. In another embodiment, the PGD2S inhibitor is a pharmaceutically acceptable salt of one of the above compounds.

In another embodiment, the PGD2S inhibitor is 2-[(1R)-9-(4-chlorobenzyl)-8-((R)-methylsulfinyl)-2,3,4,9-tetrahydro-1H-carbazol-1-yl]acetic acid and 2-[(1R)-9-(4-chlorobenzy-1)-8-((S)-methylsulfinyl-2,3,4,9-tetrahydro-1H-carbazol-1-yl]acetic acid.

In another embodiment, the PGD2S inhibitor has one of the following formulas:

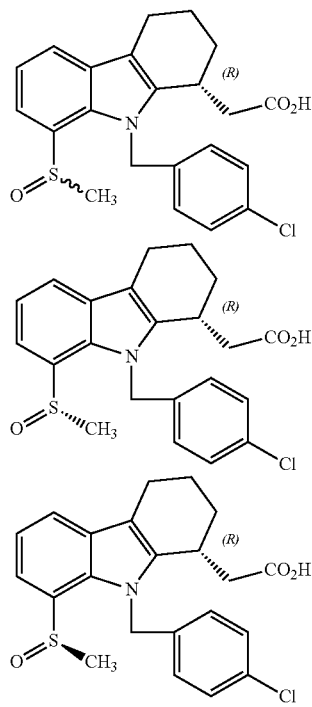

In another embodiment, the PGD2S inhibitor is 2-[(1R)-9-(4-chlorobenzyl)-8-((S)-methylsulfinyl)-2,3,4,9-tetrahydro-1H-carbazol-1-yl]acetic acid. In another embodiment, the PGD2S inhibitor is substantially pure 2-[(1R)-9-(4-chlorobenzyl)-8-((S)-methylsulfinyl)-2,3,4,9-tetrahydro-1H-carbazol-1-yl]acetic acid.

In another embodiment, the PGD2S inhibitor is 2-[(1R)-9-(4-chlorobenzyl)-8-((R)-methylsulfinyl)-2,3,4,9-tetrahydro-1H-carbazol-1-yl]acetic acid. In another embodiment, the PGD2S inhibitor is substantially pure 2-[(1R)-9-(4-chlorobenzyl)-8-((R)-methylsulfinyl)-2,3,4,9-tetrahydro-1H-carbazol-1-yl]acetic acid.

In another embodiment, the PGD2S inhibitor has the formula:

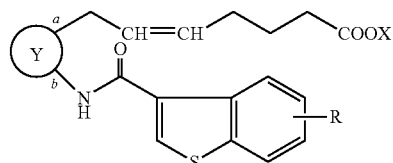

wherein:

represents

 (A)

or

 (B)

R represents hydrogen, alkyl, alkoxy, halogen, hydroxy, acyloxy, or optionally substituted arylsulfonyloxy, X represents hydrogen or alkyl, and the double bond on the □-chain has E configuration or Z configuration, provided that the compound of the formula

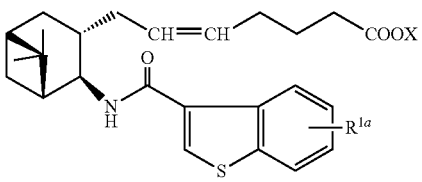

wherein R1a represents hydrogen, alkyl, or alkoxy, X is as defined above, and the double bond on the □-chain has E configuration or Z configuration is excluded.

In another embodiment, the PGD2S inhibitor is a pharmaceutically acceptable salt of one of the above PGD2S inhibitors.

In another embodiment, the PGD2S inhibitor is any other PGD2S inhibitor known in the art. Each PGD2S inhibitor represents a separate embodiment of the present invention.

In another embodiment, a compound utilized in the present invention is a CRTH2 antagonist.

In another embodiment, the CRTH2 antagonist has the structure:

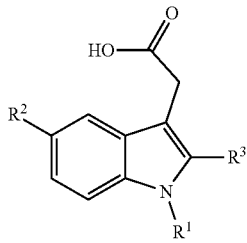

wherein:

R¹ is a 1,3-benzothiazole group optionally substituted by halogen, $C_{1-6}$ alkyl, $C_{1-6}$ alkoxy or a group of formula (A) or (B):

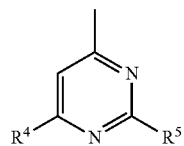

wherein R⁴ and R⁵ are independently halogen, $C_{1-6}$ allyl, $C_{1-6}$ alkoxy, phenoxy optionally substituted by halogen, $C_{1-6}$ alkyl, or $C_{1-6}$ alkoxy

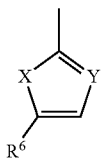

wherein one of X and Y is nitrogen and the other is nitrogen, oxygen or sulphur and R⁶ is phenyl optionally substituted by substituted by halogen, $C_{1-6}$ allyl, or $C_{1-6}$ alkoxy;
R² is hydrogen, halogen, $C_{1-6}$-alkyl, $C_{1-6}$ alkoxy, and
R³ is hydrogen or $C_{1-6}$ alkyl.

In another embodiment, "alkyl" includes straight chain and branched chain alkyl groups.

In another embodiment, R¹ of the above formula is a 1,3-benzothiazole group, or a group of formula (A). In another embodiment, the groups R⁴ and R⁵ can be the same or different. In another embodiment, R⁴ and R⁵ are both propoxy, chloro or phenoxy.

In another embodiment, the CRTH2 antagonist is [1-(2,6-diphenoxypyrimidin-4-yl)-2,5-dimethyl-1H-indol-3-yl] acetic acid. In another embodiment, the CRTH2 antagonist is [1-(2,6-diphenoxypyrimidin-4-yl)-5-methoxy-2-methyl-1H-indol-3-yl]acetic acid. In another embodiment, the CRTH2 antagonist is [1-(2,6-diisopropoxypyrimidin-4-yl)-2,5-dimethyl-1H-indol-3-yl]acetic acid. In another embodiment, the CRTH2 antagonist is [5-methoxy-2-methyl-1-(6-methyl-2-phenylpyrimidin4-yl)-1H-indol-3-yl]acetic acid. In another embodiment, the CRTH2 antagonist is [1-(2,6-dichloropyrimidin-4-yl)-2,5-dimethyl-1H-indol-3-yl]acetic acid. In another embodiment, the CRTH2 antagonist is [1-(1,3-benzothiazol-2-yl)-5-methoxy-2-methyl-1H-indol-3-yl]acetic acid. In another embodiment, the CRTH2 antagonist is a pharmaceutically acceptable salt of one of the above compounds.

In another embodiment, the CRTH2 antagonist has the structure:

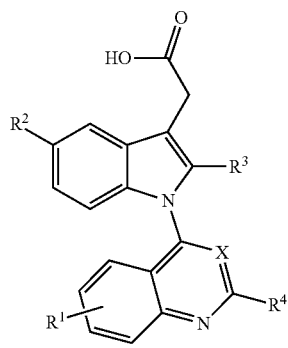

wherein:
R¹ is hydrogen, halogen, $C_{1-6}$ alkyl, or $C_{1-6}$ alkoxy;
R² is hydrogen, halogen, $C_{1-6}$ alkyl, or $C_{1-6}$ alkoxy;
R³ is hydrogen or $C_{1-6}$ alkyl;
R⁴ is hydrogen, $C_{1-6}$ alkyl, $C_{1-6}$ alkoxy, or thio$C_{1-6}$ alkyl; and
X is N or CH.

In another embodiment, "alkyl" includes straight chain and branched chain alkyl groups.

In another embodiment, R¹ in the above formula is hydrogen, chloro or methyl.

In another embodiment, R² is methyl, iso-propyl or methoxy.

In another embodiment, R⁴ is hydrogen or methoxy.
In another embodiment, X is CH.
In another embodiment, the CRTH2 antagonist is 1-(7-chloro-4-quinazolinyl)-2-methyl-1H-indole-3-acetic acid. In another embodiment, the CRTH2 antagonist is 5-methoxy-2-methyl-1-(4-quinazolinyl)-1H-indole-3-acetic acid. In another embodiment, the CRTH2 antagonist is 2-methyl-1-(2-methyl-4-quinazolinyl)-1H-indole-3-acetic acid. In another embodiment, the CRTH2 antagonist is 1-(6-chloro-2-quinolinyl)-5-methoxy-2-methyl-1H-indole-3-acetic acid. In another embodiment, the CRTH2 antagonist is 1-(6,8-dichloro-4-quinazolinyl)-5-methoxy-2-methyl-1H-indole-3-acetic acid. In another embodiment, the CRTH2 antagonist is 1-(4-chloro-2-quinolinyl)-5-methoxy-2-methyl-1H-indole-3-acetic acid. In another embodiment, the CRTH2 antagonist is 1-(7-chloro-4-quinazolinyl)-5-methoxy-2-methyl-1H-indole-3-acetic acid. In another embodiment, the CRTH2 antagonist is 2,5-dimethyl-1-(4-quinazolinyl)-1H-indole-3-acetic acid. In another embodiment, the CRTH2 antagonist is 1-(7-chloro-4-quinazolinyl)-5-methoxy-2-methyl-1H-indole-3-acetic acid. In another embodiment, the CRTH2 antagonist is 2,5-dimethyl-1-(4-quinazolinyl)-1H-indole-3-acetic acid. In another embodiment, the CRTH2 antagonist is 1-(7-chloro-4-quinazolinyl)-5-fluoro-1H-indole-3-acetic acid. In another embodiment, the CRTH2 antagonist is 5-methoxy-2-methyl-1-[2-(methylthio)-4-quinazolinyl]-1H-indole-3-acetic acid. In another embodiment, the CRTH2 antagonist is 5-methoxy-1-(6-methoxy-4-quinolinyl)-2-methyl-1H-indole-3-acetic acid. In another embodiment, the CRTH2 antagonist is 2-methyl-1-[2-(methylthio)-4-quinazolinyl]-1H-indole-3-acetic acid. In another embodiment, the CRTH2 antagonist is 1-[2-(ethylthio)-4-quinazolinyl]-5-methoxy-2-methyl-1H-indole-3-acetic acid. In another embodiment, the CRTH2 antagonist is 1-(7-chloro-4-quinazolinyl)-2,5-dimethyl-1H-indole-3-acetic acid. In another embodiment, the CRTH2 antagonist is 1-(7-chloro-4-quinazolinyl)-2-methyl-5-(1-methylethyl)-1H-indole-3-acetic acid. In another embodiment, the CRTH2 antagonist is 2,5-dimethyl-1-[2-(methylthio)-4-quinazolinyl]-1H-indole-3-acetic acid. In another embodiment, the CRTH2 antagonist is 1-(7-chloro-4-quinazolinyl)-2-methyl-5-(2-methylpropoxy)-1H-indole-3-acetic acid. In another embodiment, the CRTH2 antagonist is 1-(7-chloro-4-quinolinyl)-2-methyl-1H-indole-3-acetic acid. In another embodiment, the CRTH2 antagonist is 1-(7-chloro-2-methyl-4-quinolinyl)-5-methoxy-2-methyl-1H-indole-3-acetic acid. In another embodiment, the CRTH2 antagonist is 5-methoxy-2-methyl-1-(7-methyl-4-quinolinyl)-1H-indole-3-acetic acid. In another embodiment, the CRTH2 antagonist is 1-(7-chloro-4-quinolinyl)-5-methoxy-2-methyl-1H-indole-3-acetic acid.

In another embodiment, the CRTH2 antagonist is a pharmaceutically acceptable salt of one of the above CRTH2 antagonists.

In another embodiment, the CRTH2 antagonist is any other CRTH2 antagonist known in the art. Each CRTH2 antagonist represents a separate embodiment of the present invention.

In another embodiment, the present invention provides a method of treating baldness in a scalp of a subject, comprising the step of contacting the subject or the scalp thereof with a compound or composition capable of decreasing a level of a prostaglandin D2 synthase enzyme, thereby treating baldness in a scalp of a subject. In another embodiment, the baldness is mediated by an AGA. In another embodiment, the compound or composition decreases the prostaglandin D2 synthase level in the target scalp. Each possibility represents a separate embodiment of the present invention.

The compound or composition utilized in methods and compositions of the present invention is, in another embodiment, an antisense nucleotide molecule. In another embodiment, the compound or composition is an RNA inhibitory molecule. In another embodiment, the compound or composition is an RNA molecule. In another embodiment, the compound or composition is an inhibitory RNA (RNAi) molecule. In another embodiment, the RNA molecule is a short hairpin RNA (shRNA). In another embodiment, the RNA molecule is a small inhibitory RNA (siRNA). In another embodiment, the RNA molecule is a microRNA (miRNA). The use of siRNA and miRNA has been described, inter alia, in (Caudy A A et al, Genes & Devel 16: 2491-96 and references cited therein). In another embodiment, the RNA molecule is an anti-sense locked-nucleic acid (LNA) oligonucleotide. In another embodiment, the RNA molecule is any type of inhibitory RNA enumerated or described in Banan M et al (The ins and outs of RNAi in mammalian cells. Curr Pharm Biotechnol. 2004 October; 5(5):441-50. In another embodiment, the RNA molecule is any type of RNAi known in the art.

In another embodiment, an antisense nucleotide or RNA inhibitory molecule (of any of the types mentioned above) hybridizes with a nucleotide molecule encoding a prostaglandin D2 synthase enzyme. In another embodiment, the antisense nucleotide or RNA inhibitory molecule induces degradation of a nucleotide molecule encoding a prostaglandin D2 synthase enzyme. In another embodiment, the antisense nucleotide or RNA inhibitory molecule hybridizes with a nucleotide molecule encoding a protein selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, and CORIN. In another embodiment, the antisense nucleotide or RNA inhibitory molecule induces degradation of a nucleotide molecule encoding a protein selected from CCL18, Col11A1, Col3A1, CD4, Cd1a, FCER1A, HLA-C, and HLA-DPA1. In another embodiment, the antisense nucleotide or RNA inhibitory molecule induces degradation of a nucleotide molecule encoding a protein selected from IGF1, GPR105, PDGFRL, ADRA2A, CCL19, and CORIN. In another embodiment, the nucleotide molecule is a mRNA. In another embodiment, the nucleotide molecule is a transcript. In another embodiment, the nucleotide molecule is a genomic sequence. Each possibility represents a separate embodiment of the present invention.

Methods for topical delivery of antisense nucleotides are well known in the art, and are described, for example, in Jiang M et al (Gel-based application of siRNA to human epithelial cancer cells induces RNAi-dependent apoptosis. Oligonucleotides. 2004 Winter; 14(4):239-48) and in de Jonge J et al (Reconstituted influenza virus envelopes as an efficient carrier system for cellular delivery of small-interfering RNAs. Gene Ther. 2006 March; 13(5):400-11). Each method represents a separate embodiment of the present invention.

The PGD2S enzyme targeted by methods and compositions of the present invention is, in another embodiment, a lipocalin PGD2S enzyme. In another embodiment, the PGD2S enzyme is a hematopoietic PGD2S enzyme. Each possibility represents a separate embodiment of the present invention.

In another embodiment, the PGD2S enzyme has the sequence:

```
                                      (SEQ ID No: 252)
MATHHTLWMGLALLGVLGDLQAAPEAQVSVQPNFQQDKFLGRWFSAGLAS

NSSWLREKKAALSMCKSVVAPATDGGLNLTSTFLRKNQCETRTMLLQPAG

SLGSYSYRSPHWGSTYSVSVVETDYDQYALLYSQGSKGPGEDFRMATLYS

RTQTPRAELKEKFTAFCKAQGFTEDTIVFLPQTDKCMTEQ.
```

In another embodiment, the PGD2S enzyme is a homologue of SEQ ID No: 252. In another embodiment, the PGD2S enzyme is a variant of SEQ ID No: 252. In another embodiment, the PGD2S enzyme is an isomer of SEQ ID No: 252. In another embodiment, the PGD2S enzyme is a fragment of the protein having a sequence set forth in SEQ ID No: 252. Each possibility represents another embodiment of the present invention.

In another embodiment, the PGD2S enzyme has the sequence:

```
                                      (SEQ ID No: 267)
MATHHTLWMGLALLGVLGDLQAAPEAQVSVQPNFQQDKFLGRWFSAGLAS

NSSWLREKKAALSMCKSVVAPATDGGLNLTSTFLRKNQCETRTMLLQPAG

SLGSYSYRSPHWGSTYSVSVVETDYDQYALLYSQGSKGPGEDFRMATLYS

RTQTPRAELKEKFTAFCKAQGFTEDTIVFLPQTDKCMTEQ.
```

In another embodiment, the PGD2S enzyme is a homologue of SEQ ID No: 267. In another embodiment, the PGD2S enzyme is a variant of SEQ ID No: 267. In another embodiment, the PGD2S enzyme is an isomer of SEQ ID No: 267. In another embodiment, the PGD2S enzyme is a fragment of the protein having a sequence set forth in SEQ ID No: 267. Each possibility represents another embodiment of the present invention.

In another embodiment, the PGD2S enzyme has an amino acid (AA) sequence set forth in one of the following GenBank entries: NM_000954, AK075333, BC005939, BC041463, M61900, M61901, BC005939, BC041463, AY026356, BT019921, and BT019922, AL807752, CAI12758, DQ297141, ABB84464, M98538, AAB51074, M98539, AA621632, AI659247, AAK07679, AAH05939, AAH41463, BG037037, BM686612, AAV38724, AAV38725, CR594734, CR610092, CR612267, CR614437, AAA36494, and AAA36496. In another embodiment, the PGD2S enzyme has a nucleotide sequence set forth in one of the above GenBank entries. In another embodiment, the PGD2S enzyme has a nucleotide or AA sequence set forth in a GenBank entry for a beta-trace protein. In another embodiment, the PGD2S enzyme has a nucleotide or AA sequence set forth in a GenBank entry for a prostaglandin-H2 D-isomerase protein. In another embodiment, the PGD2S enzyme has a nucleotide or AA sequence set forth in a GenBank entry for a glutathione-independent PGD synthase protein. In another embodiment, the PGD2S enzyme is a homologue of a sequence set forth in one of the above GenBank entries. In another embodiment, the PGD2S enzyme is a variant of a sequence set forth in one of the above GenBank entries. In another embodiment, the PGD2S enzyme is an isomer of a sequence set forth in one of the above GenBank entries. In another embodiment, the PGD2S enzyme is a fragment of a sequence set forth in one of the above GenBank entries. In another embodiment, the PGD2S enzyme comprises a sequence set forth in one of the above GenBank entries. Each possibility represents a separate embodiment of the present invention.

In another embodiment, a method of the present invention functions by reducing an amount of lipocalin PGD2S (L-PGD2) in a subject. In another embodiment, a method of the present invention functions by inactivating the L-PGD2 or a fraction thereof in a subject.

In another embodiment, the present invention provides a method of stimulating a hair growth in a subject, comprising the step of contacting the subject or the skin or scalp thereof with a compound or composition capable of increasing an activity of a target gene of the present invention, thereby stimulating a hair growth in a subject. In another embodiment, the compound or composition increases the target gene activity in the target scalp or skin. Each possibility represents a separate embodiment of the present invention.

In another embodiment, the present invention provides a method of stimulating a hair growth in a subject, comprising the step of contacting the subject or the skin or scalp thereof with a compound or composition capable of increasing an expression of a target gene of the present invention, thereby stimulating a hair growth in a subject. In another embodiment, the compound or composition increases the target gene expression in the target scalp or skin. In another embodiment, the compound or composition increases the level of a protein encoded by the target gene in the target scalp or skin. Each possibility represents a separate embodiment of the present invention.

In another embodiment, the present invention provides a method of stimulating a hair growth in a subject, comprising the step of contacting the subject or the skin or scalp thereof with a protein product of a target gene of the present invention, thereby stimulating a hair growth in a subject. In another embodiment, a mimetic of the protein product is administered. In another embodiment, an analogue of the protein product is administered. In another embodiment, the compound or composition increases the protein product concentration in the target scalp or skin. In another embodiment, the protein product is FGF18. In another embodiment, the protein is a product of a target gene selected from GPRC5D, GPR49, LRRC15, Serpin A, and CDT6. In another embodiment, the protein is a product of a target gene is selected from BMP2, LHX2, THBS1, MYCN, NR4A2, MEST, TM4SF1, CRLF1, TNFRSF12A, SELENBP1, GPR161, HEPH, FZD7, and CLIC4. In another embodiment, the protein product is a product of any target gene of the present invention. Each possibility represents a separate embodiment of the present invention.

The compound or composition capable of increasing an expression of a target protein that is utilized in a method or composition of the present invention, is, in another embodiment, a nucleotide encoding the target protein. In another embodiment, the compound or composition positively regulates expression of the gene encoding the target protein. In another embodiment, the compound or composition positively regulates transcription of the gene encoding the target protein. In another embodiment, the compound or composition positively regulates translation of an RNA molecule encoding the target protein. In another embodiment, the compound or composition positively regulates expression of the target protein in a post-translational fashion. Each possibility represents a separate embodiment of the present invention.

In another embodiment, the target gene of methods and compositions of the present invention is FGF18. In another embodiment, the target gene is GPRC5D. In another embodiment, the target gene is GPR49. In another embodiment, the target gene is LRRC15. In another embodiment, the target gene is Serpin A. In another embodiment, the target gene is BMP2. In another embodiment, the target gene is LHX2. In another embodiment, the target gene is THBS1. In another embodiment, the target gene is MYCN. In another embodiment, the target gene is NR4A2. In another embodiment, the target gene is MEST. In another embodiment, the target gene is TM4SF1. In another embodiment, the target gene is CRLF1. In another embodiment, the target gene is TNFRSF12A. In another embodiment, the target gene is SELENBP1. In another embodiment, the target gene is GPR161. In another embodiment, the target gene is HEPH. In another embodiment, the target gene is FZD7. In another embodiment, the target gene is CLIC4. In another embodiment, the target gene is CDT6. In another embodiment, the target gene is another gene having a sequence selected from the sequences set forth in SEQ ID No: 1-251. In another embodiment, the target gene is another gene having a sequence selected from the sequences set forth in SEQ ID No: 277-303. Each possibility represents a separate embodiment of the present invention.

In another embodiment, the target gene is a gene from FIG. 13. In another embodiment, a cell surface protein from FIG. 13 is utilized for isolating subpopulations of cells for tissue engineering. In another embodiment, a signaling molecule from FIG. 13 is utilized as a drug target. In another embodiment, a growth factor from FIG. 13 is utilized as a target protein. In another embodiment, a transcription factor from FIG. 13 is utilized is utilized as a target protein. In another embodiment, a cytokine from FIG. 13 is utilized is utilized as a target protein. In another embodiment, a G-protein-coupled receptor from FIG. 13 is utilized is utilized as a target protein. In another embodiment, a protein from FIG. 13 with a biological activity related to miniaturization of the hair follicle in baldness is utilized as a target protein.

As provided herein, findings of the present invention demonstrate that various target genes (e.g. FGF18, GPRC5D, GPR49, LRRC15, CDT6, Serpin A, BMP2, LHX2, THBS1, MYCN, NR4A2, MEST, TM4SF1, CRLF1, TNFRSF12A, SELENBP1, GPR161, HEPH, FZD7, and CLIC4) are up-regulated in haired scalp. Thus, increasing expression or activity of products of these genes in bald scalp will stimulate hair growth. The common categories listed in FIG. 4D for the haired scalp exemplified genes that are enriched in a sample of anagen and terminal HF, relative to telogen and vellus HF (FIG. 1). This analysis therefore determined genes enriched in human anagen and terminal follicles.

Many of the genes of highest significance were related to inflammation. The 3 most populated gene function categories are response to biotic stimulus, defense response and immune response with p values ranging from $1.81 \times 10^{-2}$ to $2.67 \times 10^{-2}$. The category most commonly represented—response to biotic stimulus—is defined, in another embodiment, as: "A change in state or activity of a cell or an organism (in terms of movement, secretion, enzyme production, gene expression, etc.) as a result of a biotic stimulus, a stimulus caused or produced by a living organism" (Hill D P, Begley D A, Finger J H, Hayamizu T F, McCright I J, Smith C M, Beal J S, Corbani L E, Blake J A, Eppig J T, Kadin J A, Richardson J E, Ringwald M. 2004. The mouse Gene Expression Database (GXD): updates and enhancements. Nucleic Acids Res 32: D568-D571).

Further, bald scalp exhibited a relative decrease in the proportion of alpha-6 integrin negative cells within the stem cell compartment. This is due, in another embodiment, to a decrease in the number of cell layers of the outer root sheath as the follicle miniaturizes. Since the suprabasal alpha-6 integrin negative bulge population is likely to be a progeny population from the basal layer, these findings show that, under the conditions utilized herein, haired scalp possesses a higher state of activation and division in the basal layer stem cell compartment compared with bald scalp.

Thus, findings of the present invention reveal genes that participate in hair growth, healthy HF maintenance and cycling, and hair loss, that can be used as targets of method of the present invention.

The FGF18 protein targeted by methods and compositions of the present invention has, in another embodiment, the sequence:

(SEQ ID No: 253)
MYSAPSACTCLCLHFLLLCFQVQVLVAEENVDFRIHVENQTRARDDVSRK

QLRLYQLYSRTSGKHIQVLGRRISARGEDGDKYAQLLVETDTFGSQVRIK

GKETEFYLCMNRKGKLVGKPDGTSKECVFIEKVLENNYTALMSAKYSGWY

VGFTKKGRPRKGPKTRENQQDVHFMKRYPKGQPELQKPFKYTTVTKRSRR

IRPTHPA.

In another embodiment, the FGF18 protein has an AA sequence set forth in one of the following GenBank entries: NM_003862, BC006245, AF075292, BC006245, NM_033649, AF211188, AY358811, BT019570, BT019571, and AB007422. In another embodiment, the FGF18 protein is encoded by a gene having a nucleotide sequence set forth in one of the above GenBank entries. In another embodiment, the FGF18 protein is a homologue of a sequence set forth in one of the above GenBank entries. In another embodiment, the FGF18 protein is a variant of a sequence set forth in one of the above GenBank entries. In another embodiment, the FGF18 protein is an isomer of a sequence set forth in one of the above GenBank entries. In another embodiment, the FGF18 protein is a fragment of a sequence set forth in one of the above GenBank entries. In another embodiment, the FGF18 protein comprises a sequence set forth in one of the above GenBank entries. Each possibility represents a separate embodiment of the present invention.

The GPRC5D protein targeted by methods and compositions of the present invention has, in another embodiment, the sequence:

(SEQ ID No: 254)
MYKDCIESTGDYFLLCDAEGPWGIILESLAILGIVVTILLLLAFLFLMRK

IQDCSQWNVLPTQLLFLLSVLGLFGLAFAFIIELNQQTAPVRYFLFGVLF

ALCFSCLLAHASNLVKLVRGCVSFSWTTILCIAIGCSLLQIIIATEYVTL

IMTRGMMFVNMTPCQLNVDFVVLLVYVLFLMALTFFVSKATFCGPCENWK

QHGRLIFITVLFSIIIWVVWISMLLRGNPQFQRQPQWDDPVVCIALVTNA

WVFLLLYIVPELCILYRSCRQECPLQGNACPVTAYQHSFQVENQELSRAR

DSDGAEEDVALTSYGTPIQPQTVDPTQECFIPQAKLSPQQDAGGV.

In another embodiment, the GPRC5D protein is encoded by a gene located at 12p13.3.

In another embodiment, the GPRC5D protein has an AA sequence set forth in one of the following GenBank entries: NM_018654, BC069341, BC107077, BC107078, AF209923, BC069341, and AB099817. In another embodiment, the GPRC5D protein is encoded by a gene having a nucleotide sequence set forth in one of the above GenBank entries. In another embodiment, the GPRC5D protein is a homologue of a sequence set forth in one of the above GenBank entries. In another embodiment, the GPRC5D protein is a variant of a sequence set forth in one of the above GenBank entries. In another embodiment, the GPRC5D protein is an isomer of a sequence set forth in one of the above GenBank entries. In another embodiment, the GPRC5D protein is a fragment of a sequence set forth in one of the above GenBank entries. In another embodiment, the GPRC5D protein comprises a sequence set forth in one of the above GenBank entries. Each possibility represents a separate embodiment of the present invention.

The GPR49 protein targeted by methods and compositions of the present invention is a protein that would be encoded, in another embodiment, by a gene having the sequence:

(SEQ ID No: 255)
ttatwahaaatttattttttaacccaatagaaaagcaaatttggaatctat ttacaagtactatatatttacatatatacagttagagtgggagatttaaa gaaaatgggcagagaaacacaatataaatcaaagaatatgccactgtaca aggcattattatcattatcatggtccttaatgttactgaacctttactat agtaataaatacagttctatatttacacatcttataaaacatctcataaa tgtattttttcaaatccaagthaaaacatctgatcaaaataaacatgctt atataaaaataaatctacctaacagccatttggtttggatgtattgargc taatataggataatagagggtaagrbttaatactttgacttttcttattt aataacttgcttcttaaaatacctaacacagtattaatatggaatargcr

```
gagargtaatgttcctaacatcaagtgggttatccagagagaacacagct aaaaccaagctaaataaacaggataatacgttactgagtctcttgagtcc aaagtggtgtcagatattgggtttgccagagctactagagatacatgtgt gagaggttgtatcagtggacttaatttatgtgatgtgcacatttgatcat taagatgcacatcagtttgaatcaactgataaaacttattgcaaaaattc tttactaacccagaaaaaaaatcccagattgcttactttcttttccaggt atgtycattgctggcagtggaattcccttctgagctttgggcmcaaggag ttaaaaacaaatcagataagacatacgtcacctgtscatgattsccttag taacaatttaagaattttggtcagttttttctttcaaaatacttgtaagca gttttatcccatgakggtggaccatctagtgctgatacataaamctggta tctctaaaawtgatctcaatatgagtgagtaacaatacytwacattacca yctaagggattgtscttagaaggatctttc.
```

In another embodiment, the GPR49 protein is encoded by a gene located at 12q22-q23.

In another embodiment, the GPR49 protein has an AA sequence set forth in one of the following GenBank entries: AK075399, BC096324, BC096325, BC099650, BC096326, AF062006, and AF061444. In another embodiment, the GPR49 protein is encoded by a gene having a nucleotide sequence set forth in one of the above GenBank entries. In another embodiment, the GPR49 protein has an AA or nucleotide sequence set forth in a GenBank entry for an LGF5 protein. In another embodiment, the GPR49 protein has an AA or nucleotide sequence set forth in a GenBank entry for an HG38 protein. In another embodiment, the GPR49 protein is a homologue of a sequence set forth in one of the above GenBank entries. In another embodiment, the GPR49 protein is a variant of a sequence set forth in one of the above GenBank entries. In another embodiment, the GPR49 protein is an isomer of a sequence set forth in one of the above GenBank entries. In another embodiment, the GPR49 protein is a fragment of a sequence set forth in one of the above GenBank entries. In another embodiment, the GPR49 protein comprises a sequence set forth in one of the above GenBank entries. Each possibility represents a separate embodiment of the present invention.

The LRRC15 protein targeted by methods and compositions of the present invention has, in another embodiment, the sequence:

```
                                        (SEQ ID No: 256)
MPLKHYLLLLVGCQAWGAGLAYHGCPSECTCSRASQVECTGARIVAVPTP

LPWNAMSLQILNTHITELNESPFLNISALIALRIEKNELSRITPGAFRNL

GSLRYLSLANNKLQVLPIGLFQGLDSLESLLLSSNQLLQIQPAHFSQCSN

LKELQLHGNHLEYIPDGAFDHLVGLTKLNLGKNSLTHISPRVFQHLGNLQ

VLRLYENRLTDIPMGTFDGLVNLQELALQQNQIGLLSPGLFHNNHNLQRL

YLSNNHISQLPPSIFMQLPQLNRLTLFGNSLKELSLGIFGPMPNLRELWL

YDNHISSLPDNVFSNLRQLQVLILSRNQISFISPGAFNGLTELRELSLHT

NALQDLDGNVFRMLANLQNISLQNNRLRQLPGNIFANVNGLMAIQLQNNQ

LENLPLGIFDHLGKLCELRLYDNPWRCDSDILPLRNWLLLNQPRLGTDTV

PVCFSPANVRGQSLIIINVNVAVPSVHVPEVPSYPETPWYPDTPSYPDTT

SVSSTTELTSPVEDYTDLTTIQVTDDRSVWGMTQAQSGLAIAAIVIGIVA

LACSLAACVGCCCCKKRSQAVLMQMKAPNEC.
```

In another embodiment, the LRRC15 protein has an AA sequence set forth in one of the following GenBank entries: AB071037, BC101064, BC101065, and BK001325. In another embodiment, the LRRC15 protein is encoded by a gene having a nucleotide sequence set forth in one of the above GenBank entries. In another embodiment, the LRRC15 protein is a homologue of a sequence set forth in one of the above GenBank entries. In another embodiment, the LRRC15 protein is a variant of a sequence set forth in one of the above GenBank entries. In another embodiment, the LRRC15 protein is an isomer of a sequence set forth in one of the above GenBank entries. In another embodiment, the LRRC15 protein is a fragment of a sequence set forth in one of the above GenBank entries. In another embodiment, the LRRC15 protein comprises a sequence set forth in one of the above GenBank entries. Each possibility represents a separate embodiment of the present invention.

The CDT6 protein targeted by methods and compositions of the present invention has, in another embodiment, the sequence:

```
                                        (SEQ ID No: 257)
MLKKPLSAVTWLCIFIVAFVSHPAWLQKLSKHKTPAQPQLKAANCCEEVK

ELKAQVANLSSLLSELNKKQERDWVSVVMQVMELESNSKRMESRLTDAES

KYSEMNNQIDIMQLQAAQTVTQTSADAIYDCSSLYQKNYRISGVYKLPPD

DFLGSPELEVFCDMETSGGGWTIIQRRKSGLVSFYRDWKQYKQGFGSIRG

DFWLGNEHIHRLSRQPTRLRVEMEDWEGNLRYAEYSHFVLGNELNSYRLF

LGNYTGNVGNDALQYHNNTAFSTKDKDNDNCLDKCAQLRKGGYWYNCCTD

SNLNGVYYRLGEHNKHLDGITWYGWHGSTYSLKRVEMKIRPEDFKP.
```

In another embodiment, the CDT6 protein has an AA sequence set forth in one of the following GenBank entries: BC001881, NM_021146, AY358301, Y16132, and BT009802. In another embodiment, the CDT6 protein is encoded by a gene having a nucleotide sequence set forth in one of the above GenBank entries. In another embodiment, the CDT6 protein has an AA or nucleotide sequence set forth in a GenBank entry for an ANGPTL7 (Angiopoietin-like 7) protein. In another embodiment, the CDT6 protein is a homologue of a sequence set forth in one of the above GenBank entries. In another embodiment, the CDT6 protein is a variant of a sequence set forth in one of the above GenBank entries. In another embodiment, the CDT6 protein is an isomer of a sequence set forth in one of the above GenBank entries. In another embodiment, the CDT6 protein is a fragment of a sequence set forth in one of the above GenBank entries. In another embodiment, the CDT6 protein comprises a sequence set forth in one of the above GenBank entries. Each possibility represents a separate embodiment of the present invention.

The Serpin A protein targeted by methods and compositions of the present invention has, in another embodiment, the sequence:

```
                                        (SEQ ID No: 258)
MPSSVSWGILLLAGLCCLVPVSLAEDPQGDAAQKTDTSHHDQDHPTFNKI

TPNLAEFAFSLYRQLAHQSNSTNIFFSPVSIATAFAMLSLGTKADTHDEI

LEGLNFNLTEIPEAQIHEGFQELLRTLNQPDSQLQLTTGNGLFLSEGLKL
```

-continued

VDKFLEDVKKLYHSEAFTVNFGDTEEAKKQINDYVEKGTQGKIVDLVKEL

DRDTVFALVNYIFFKGKWERPFEVKDTEEEDFHVDQATTVKVPMMKRLGM

FNIQHCKKLSSWVLLMKYLGNATAIFFLPDEGKLQHLENELTHDIITKFL

ENEDRRSASLHLPKLSITGTYDLKSVLGQLGITKVFSNGADLSGVTEEAP

LKLSKAVHKAVLTIDEKGTEAAGAMFLEAIPMSIPPEVKFNKPFVFLMIE

QNTKSPLFMGKVVNPTQK.

In another embodiment, the Serpin A protein has an AA sequence set forth in one of the following GenBank entries: BC015642, BC011991, NM_000295, BC070163, AK026174, X01683, NM_001002236, M11465, NM_001002235, V00496, X02920, and K01396. In another embodiment, the Serpin A protein is encoded by a gene having a nucleotide sequence set forth in one of the above GenBank entries. In another embodiment, the Serpin A protein is a Serpin A1 protein. In another embodiment, the Serpin A protein is any other Serpin A protein known in the art. In another embodiment, the Serpin A protein is a homologue of a sequence set forth in one of the above GenBank entries. In another embodiment, the Serpin A protein is a variant of a sequence set forth in one of the above GenBank entries. In another embodiment, the Serpin A protein is an isomer of a sequence set forth in one of the above GenBank entries. In another embodiment, the Serpin A protein is a fragment of a sequence set forth in one of the above GenBank entries. In another embodiment, the Serpin A protein comprises a sequence set forth in one of the above GenBank entries. Each possibility represents a separate embodiment of the present invention.

The BMP2 protein targeted by methods and compositions of the present invention has, in another embodiment, the sequence:

(SEQ ID No: 304; GenBank Accession No. BC140325)
MVAGTRCLLALLLPQVLLGGAAGLVPELGRRKFAAASSGRPSSQPSDEVL

SEFELRLLSMFGLKQRPTPSRDAVVPPYMLDLYRRHSGQPGSPAPDHRLE

RAASRANTVRSFHHEESLEELPETSGKTTRRFFFNLSSIPTEEFITSAEL

QVFREQMQDALGNNSSFHHRINIYEIIKPATANSKFPVTRLLDTRLVNQN

ASRWESFDVTPAVMRWTAQGHANHGFVVEVAHLEEKQGVSKRHVRISRSL

HQDEHSWSQIRPLLVTFGHDGKGHPLHKREKRQAKHKQRKRLKSSCKRHP

LYVDFSDVGWNDWIVAPPGYHAFYCHGECPFPLADHLNSTNHAIVQTLVN

SVNSKIPKACCVPTELSAISMLYLDENEKVVLKNYQDMVVEGCGCR.

In another embodiment, the BMP2 protein has an AA sequence set forth in one of the following GenBank entries: BC069214, NM_001200, M22490, M22489, and AY418812. In another embodiment, the BMP2 protein is encoded by a gene having a nucleotide sequence set forth in one of the above GenBank entries. In another embodiment, the BMP2 protein is any other BMP2 protein known in the art. In another embodiment, the BMP2 protein is a homologue of a sequence set forth in one of the above GenBank entries. In another embodiment, the BMP2 protein is a variant of a sequence set forth in one of the above GenBank entries. In another embodiment, the BMP2 protein is an isomer of a sequence set forth in one of the above GenBank entries. In another embodiment, the BMP2 protein is a fragment of a sequence set forth in one of the above GenBank entries. In another embodiment, the BMP2 protein comprises a sequence set forth in one of the above GenBank entries. Each possibility represents a separate embodiment of the present invention.

The LHX2 protein targeted by methods and compositions of the present invention has, in another embodiment, the sequence:

(SEQ ID No: 305; GenBank Accession No. NM_004789)
MLFHSLSGPEVHGVIDEMDRRAKSEAPAISSAIDRGDTETTMPSISSDRA

ALCAGCGGKISDRYYLLAVDKQWHMRCLKCCECKLNLESELTCFSKDGSI

YCKEDYYRRFSVQRCARCHLGISASEMVMRARDLVYHLNCFTCTTCNKML

TTGDHFGMKDSLVYCRLHFEALLQGEYPAHFNHADVAAAAAAAAAKSAG

LGAAGANPLGLPYYNGVGTVQKGRPRKRKSPGPGADLAAYNAALSCNEND

AEHLDRDQPYPSSQKTKRMRTSFKHHQLRTMKSYFAINHNPDAKDLKQLA

QKTGLTKRVLQVWFQNARAKFRRNLLRQENTGVDKSTDAALQTGTPSGPA

SELSNASLSPSSTPTTLTDLTSPTLPTVTSVLTSVPGNLEGHEPHSPSQT

TLTNLF.

In another embodiment, the LHX2 protein has an AA sequence set forth in one of the following GenBank entries: AL158052, BC093662, BC112185, and AF124735. In another embodiment, the LHX2 protein is encoded by a gene having a nucleotide sequence set forth in one of the above GenBank entries. In another embodiment, the LHX2 protein is any other LHX2 protein known in the art. In another embodiment, the LHX2 protein is a homologue of a sequence set forth in one of the above GenBank entries. In another embodiment, the LHX2 protein is a variant of a sequence set forth in one of the above GenBank entries. In another embodiment, the LHX2 protein is an isomer of a sequence set forth in one of the above GenBank entries. In another embodiment, the LHX2 protein is a fragment of a sequence set forth in one of the above GenBank entries. In another embodiment, the LHX2 protein comprises a sequence set forth in one of the above GenBank entries. Each possibility represents a separate embodiment of the present invention.

The THBS1 protein targeted by methods and compositions of the present invention has, in another embodiment, the sequence:

(SEQ ID No: 306; GenBank Accession No. NM_003246)
MGLAWGLGVLFLMHVCGTNRIPESGGDNSVFDIFELTGAARKGSGRRLVK

GPDPSSPAFRIEDANLIPPVPDDKFQDLVDAVRAEKGFLLLASLRQMKKT

RGTLLALERKDHSGQVFSVVSNGKAGTLDLSLTVQGKQHVVSVEEALLAT

GQWKSITLFVQEDRAQLYIDCEKMENAELDVPIQSVFTRDLASIARLRIA

KGGVNDNFQGVLQNVRFVFGTTPEDILRNKGCSSSTSVLLTLDNNVVNGS

SPAIRTNYIGHKTKDLQAICGISCDELSSMVLELRGLRTIVTTLQDSIRK

VTEENKELANELRRPPLCYHNGVQYRNNEEWTVDSCTECHCQNSVTICKK

VSCPIMPCSNATVPDGECCPRCWPSDSADDGWSPWSEWTSCSTSCGNGIQ

QRGRSCDSLNNRCEGSSVQTRTCHIQECDKRFKQDGGWSHWSPWSSCSVT

CGDGVITRIRLCNSPSPQMNGKPCEGEARETKACKKDACPINGGWGPWSP

WDICSVTCGGGVQKRSRLCNNPTPQFGGKDCVGDVTENQICNKQDCPIDG

-continued

```
CLSNPCFAGVKCTSYPDGSWKCGACPPGYSGNGIQCTDVDECKEVPDACF

NHNGEHRCENTDPGYNCLPCPPRFTGSQPFGQGVEHATANKQVCKPRNPC

TDGTHDCNKNAKCNYLGHYSDPMYRCECKPGYAGNGIICGEDTDLDGWPN

ENLVCVANATYHCKKDNCPNLPNSGQEDYDKDGIGDACDDDDDNDKIPDD

RDNCPFHYNPAQYDYDRDDVGDRCDNCPYNHNPDQADTDNNGEGDACAAD

IDGDGILNERDNCQYVYNVDQRDTDMDGVGDQCDNCPLEHNPDQLDSDSD

RIGDTCDNNQDIDEDGHQNNLDNCPYVPNANQADHDKDGKGDACDHDDDN

DGIPDDKDNCRLVPNPDQKDSDGDGRGDACKDDFDHDSVPDIDDICPENV

DISETDFRRFQMIPLDPKGTSQNDPNWVVRHQGKELVQTVNCDPGLAVGY

DEFNAVDFSGTFFINTERDDDYAGFVFGYQSSSRFYVVMWKQVTQSYWDT

NPTRAQGYSGLSVKVVNSTTGPGEHLRNALWHTGNTPGQVRTLWHDPRHI

GWKDFTAYRWRLSHRPKTGFIRVVMYEGKKIMADSGPIYDKTYAGGRLGL

FVFSQEMVFFSDLKYECRDP.
```

In another embodiment, the THBS1 protein has an AA sequence set forth in one of the following GenBank entries: X14787, M14326, AY405252, BC015134, and M25631. In another embodiment, the THBS1 protein is encoded by a gene having a nucleotide sequence set forth in one of the above GenBank entries. In another embodiment, the THBS1 protein is any other THBS1 protein known in the art. In another embodiment, the THBS1 protein is a homologue of a sequence set forth in one of the above GenBank entries. In another embodiment, the THBS1 protein is a variant of a sequence set forth in one of the above GenBank entries. In another embodiment, the THBS1 protein is an isomer of a sequence set forth in one of the above GenBank entries. In another embodiment, the THBS1 protein is a fragment of a sequence set forth in one of the above GenBank entries. In another embodiment, the THBS1 protein comprises a sequence set forth in one of the above GenBank entries. Each possibility represents a separate embodiment of the present invention.

The MYCN protein targeted by methods and compositions of the present invention has, in another embodiment, the sequence:

```
(SEQ ID No: 307; GenBank Accession No. BC002712)
MPSCSTSTMPGMICKNPDLEFDSLQPCFYPDEDDFYFGGPDSTPPGEDIW

KKFELLPTPPLSPSRGFAEHSSEPPSWVTEMLLENELWGSPAEEDAFGLG

GLGGLTPNPVILQDCMWSGFSAREKLERAVSEKLQHGRGPPTAGSTAQSP

GAGAASPAGRGHGGAAGAGRAGAALPAELAHPAAECVDPAVVFPFPVNKR

EPAPVPAAPASAPAAGPAVASGAGIAAPAGAPGVAPPRPGGRQTSGGDHK

ALSTSGEDTLSDSDDEDDEEEDEEEEIDVVTVEKRRSSSNTKAVTTFTIT

VRPKNAALGPGRAQSSELILKRCLPIHQQHNYAAPSPYVESEDAPPQKKI

KSEASPRPLKSVIPPKAKSLSPRNSDSEDSERRRNHNILERQRRNDLRSS

FLTLRDHVPELVKNEKAAKVVILKKATEYVHSLQAEEHQLLLEKEKLQAR

QQQLLKKIEHARTC.
```

In another embodiment, the MYCN protein has an AA sequence set forth in GenBank Accession Number NM_005378. In another embodiment, the MYCN protein is encoded by a gene having a nucleotide sequence set forth in one of the above GenBank entries. In another embodiment, the MYCN protein is any other MYCN protein known in the art. In another embodiment, the MYCN protein is a homologue of a sequence set forth in one of the above GenBank entries. In another embodiment, the MYCN protein is a variant of a sequence set forth in one of the above GenBank entries. In another embodiment, the MYCN protein is an isomer of a sequence set forth in one of the above GenBank entries. In another embodiment, the MYCN protein is a fragment of a sequence set forth in one of the above GenBank entries. In another embodiment, the MYCN protein comprises a sequence set forth in one of the above GenBank entries. Each possibility represents a separate embodiment of the present invention.

The NR4A2 protein targeted by methods and compositions of the present invention has, in another embodiment, the sequence:

```
(SEQ ID No: 308; GenBank Accession No. NM_006186)
MPCVQAQYGSSPQGASPASQSYSYHSSGEYSSDFLTPEFVKFSMDLTNTE

ITATTSLPSFSTFMDNYSTGYDVKPPCLYQMPLSGQQSSIKVEDIQMHNY

QQHSHLPPQSEEMMPHSGSVYYKPSSPPTPTTPGFQVQHSPMWDDPGSLH

NFHQNYVATTHMIEQRKTPVSRLSLFSFKQSPPGTPVSSCQMRFDGPLHV

PMNPEPAGSHHVVDGQTFAVPNPIRKPASMGFPGLQIGHASQLLDTQVPS

PPSRGSPSNEGLCAVCGDNAACQHYGVRTCEGCKGFFKRTVQKNAKYVCL

ANKNCPVDKRRRNRCQYCRFQKCLAVGMVKEVVRTDSLKGRRGRLPSKPK

SPQEPSPPSPPVSLISALVRAHVDSNPAMTSLDYSRFQANPDYQMSGDDT

QHIQQFYDLLTGSMEIIRGWAEKIPGFADLPKADQDLLFESAFLELFVLR

LAYRSNPVEGKLIFCNGVVLHRLQCVRGFGEWIDSIVEFSSNLQNMNIDI

SAFSCIAALAMVTERHGLKEPKRVEELQNKIVNCLKDHVTFNNGGLNRPN

YLSKLLGKLPELRTLCTQGLQRIFYLKLEDLVPPPAIIDKLFLDTLPF.
```

In another embodiment, the NR4A2 protein has an AA sequence set forth in one of the following GenBank entries: NM_173171, NM_173172, NM_173173, and X75918. In another embodiment, the NR4A2 protein is encoded by a gene having a nucleotide sequence set forth in one of the above GenBank entries. In another embodiment, the NR4A2 protein is any other NR4A2 protein known in the art. In another embodiment, the NR4A2 protein is a homologue of a sequence set forth in one of the above GenBank entries. In another embodiment, the NR4A2 protein is a variant of a sequence set forth in one of the above GenBank entries. In another embodiment, the NR4A2 protein is an isomer of a sequence set forth in one of the above GenBank entries. In another embodiment, the NR4A2 protein is a fragment of a sequence set forth in one of the above GenBank entries. In another embodiment, the NR4A2 protein comprises a sequence set forth in one of the above GenBank entries. Each possibility represents a separate embodiment of the present invention.

The MEST protein targeted by methods and compositions of the present invention has, in another embodiment, the sequence:

(SEQ ID No: 309; GenBank Accession No. BC002413)
MVRRDRLRRMREWWVQVGLLAVPLLAAYLHIPPPQLSPALHSWKSSGKFF

TYKGLRIFYQDSVGVVGSPEIVVLLHGFPTSSYDWYKIWEGLTLRFHRVI

ALDFLGFGFSDKPRPHHYSIFEQASIVEALLRHLGLQNRRINLLSHDYGD

IVAQELLYRYKQNRSGRLTIKSLCLSNGGIFPETHRPLLLQKLLKDGGVL

SPILTRLMNFFVFSRGLTPVFGPYTRPSESELWDMWAGIRNNDGNLVIDS

LLQYINQRKKFRRRWVGALASVTIPIHFIYGPLDPVNPYPEFLELYRKTL

PRSTVSILDDHISHYPQLEDPMGFLNAYMGFINSF.

In another embodiment, the MEST protein has an AA sequence set forth in one of the following GenBank entries: BC011908, BC014564, BC018695, BC090049, NM_002402, NM_177524, NM_177525, AK098397, D78611, D87367, and Y11534. In another embodiment, the MEST protein is encoded by a gene having a nucleotide sequence set forth in one of the above GenBank entries. In another embodiment, the MEST protein is any other MEST protein known in the art. In another embodiment, the MEST protein is a homologue of a sequence set forth in one of the above GenBank entries. In another embodiment, the MEST protein is a variant of a sequence set forth in one of the above GenBank entries. In another embodiment, the MEST protein is an isomer of a sequence set forth in one of the above GenBank entries. In another embodiment, the MEST protein is a fragment of a sequence set forth in one of the above GenBank entries. In another embodiment, the MEST protein comprises a sequence set forth in one of the above GenBank entries. Each possibility represents a separate embodiment of the present invention.

The TM4SF1 protein targeted by methods and compositions of the present invention has, in another embodiment, the sequence:

(SEQ ID No: 310; GenBank Accession No. BC008442)
MCYGKCARCIGHSLVGLALLCIAANILLYFPNGETKYASENHLSRFVWFF

SGIVGGGLLMLLPAFVFIGLEQDDCCGCCGHENCGKRCAMLSSVLAALIG

IAGSGYCVIVAALGLAEGPLCLDSLGQWNYTFASTEGQYLLDTSTWSECT

EPKHIVEWNVSLFSILLALGGIEFILCLIQVINGVLGGICGFCCSHQQQY

DC.

In another embodiment, the TM4SF1 protein has an AA sequence set forth in one of the following GenBank entries: AL832780, X75684, BC034145, AK093829, AK130073, and AK130271. In another embodiment, the TM4SF1 protein is encoded by a gene having a nucleotide sequence set forth in one of the above GenBank entries. In another embodiment, the TM4SF1 protein is any other TM4SF1 protein known in the art. In another embodiment, the TM4SF1 protein is a homologue of a sequence set forth in one of the above GenBank entries. In another embodiment, the TM4SF1 protein is a variant of a sequence set forth in one of the above GenBank entries. In another embodiment, the TM4SF1 protein is an isomer of a sequence set forth in one of the above GenBank entries. In another embodiment, the TM4SF1 protein is a fragment of a sequence set forth in one of the above GenBank entries. In another embodiment, the TM4SF1 protein comprises a sequence set forth in one of the above GenBank entries. Each possibility represents a separate embodiment of the present invention.

The CRLF1 protein targeted by methods and compositions of the present invention has, in another embodiment, the sequence:

(SEQ ID No: 311; GenBank Accession No. BC044634)
MPAGRRGPAAQSARRPPPLLPLLLLLCVLGAPRAGSGAHTAVISPQDPTL

LIGSSLLATCSVHGDPPGATAEGLYWTLNGRRLPPELSRVLNASTLALAL

ANLNGSRQRSGDNLVCHARDGSILAGSCLYVGLPPEKPVNISCWSKNMKD

LTCRWTPGAHGETFLHTNYSLKYKLRWYGQDNTCEEYHTVGPHSCHIPKD

LALFTPYEIWVEATNRLGSARSDVLTLDILDVVTTDPPPDVHVSRVGGLE

DQLSVRWVSPPALKDFLFQAKYQIRYRVEDSVDWKVVDDVSNQTSCRLAG

LKPGTVYFVQVRCNPFGIYGSKKAGIWSEWSHPTAASTPRSERPGPGGGA

CEPRGGEPSSGPVRRELKQFLGWLKKHAYCSNLSFRLYDQWRAWMQKSHK

TRNQDEGILPSGRRGTARGPAR.

In another embodiment, the CRLF1 protein has an AA sequence set forth in one of the following GenBank entries: AF059293, AF073515, AF178684, NM_004750, and AY358291. In another embodiment, the CRLF1 protein is encoded by a gene having a nucleotide sequence set forth in one of the above GenBank entries. In another embodiment, the CRLF1 protein is any other CRLF1 protein known in the art. In another embodiment, the CRLF1 protein is a homologue of a sequence set forth in one of the above GenBank entries. In another embodiment, the CRLF1 protein is a variant of a sequence set forth in one of the above GenBank entries. In another embodiment, the CRLF1 protein is an isomer of a sequence set forth in one of the above GenBank entries. In another embodiment, the CRLF1 protein is a fragment of a sequence set forth in one of the above GenBank entries. In another embodiment, the CRLF1 protein comprises a sequence set forth in one of the above GenBank entries. Each possibility represents a separate embodiment of the present invention.

The TNFRSF12A protein targeted by methods and compositions of the present invention has, in another embodiment, the sequence:

(SEQ ID No: 312; GenBank Accession No. BC002718)
MARGSLRRLLRLLVLGLWLALLRSVAGEQAPGTAPCSRGSSWSADLDKCM

DCASCRARPHSDFCLGCAAAPPAPFRLLWPILGGALSLTFVLGLLSGFLV

WRRCRRREKFTTPIEETGGEGCPAVALIQ.

In another embodiment, the TNFRSF12A protein has an AA sequence set forth in one of the following GenBank entries: NM_016639, AB035480, and AF191148. In another embodiment, the TNFRSF12A protein is encoded by a gene having a nucleotide sequence set forth in one of the above GenBank entries. In another embodiment, the TNFRSF12A protein is any other TNFRSF12A protein known in the art. In another embodiment, the TNFRSF12A protein is a homologue of a sequence set forth in one of the above GenBank entries. In another embodiment, the TNFRSF12A protein is a variant of a sequence set forth in one of the above GenBank entries. In another embodiment, the TNFRSF12A protein is an isomer of a sequence set forth in one of the above GenBank entries. In another embodiment, the TNFRSF12A protein is a fragment of a sequence set forth in one of the above GenBank entries. In another embodiment, the TNFRSF12A protein comprises a sequence set forth in one of the above GenBank entries. Each possibility represents a separate embodiment of the present invention.

The SELENBP1 protein targeted by methods and compositions of the present invention has, in another embodiment, the sequence:

(SEQ ID No: 313; GenBank Accession No. BC009084)
MATKCGNCGPGYSTPLEAMKGPREEIVYLPCIYRNTGTEAPDYLATVDVD

PKSPQYCQVIHRLPMPNLKDELHHSGWNTCSSCFGDSTKSRTKLVLPSLI

SSRIYVVDVGSEPRAPKLHKVIEPKDIHAKCELAFLHTSHCLASGEVMIS

SLGDVKGNGKGGFVLLDGETFEVKGTWERPGGAAPLGYDFWYQPRHNVMI

STEWAAPNVLRDGFNPADVEAGLYGSHLYVWDWQRHEIVQTLSLKDGLIP

LEIRFLHNPDAAQGFVGCALSSTIQRFYKNEGGTWSVEKVIQVPPKKVKG

WLLPEMPGLITDILLSLDDRFLYFSNWLHGDLRQYDISDPQRPRLTGQLF

LGGSIVKGGPVQVLEDEELKSQPEPLVVKGKRVAGGPQMIQLSLDGKRLY

ITTSLYSAWDKQFYPDLIREGSVMLQVDVDTVKGGLKLNPNFLVDFGKEP

LGPALAHELRYPGGDCSSDIWI.

In another embodiment, the SELENBP1 protein has an AA sequence set forth in one of the following GenBank entries: BC032997 and NM_003944. In another embodiment, the SELENBP1 protein is encoded by a gene having a nucleotide sequence set forth in one of the above GenBank entries. In another embodiment, the SELENBP1 protein is any other SELENBP1 protein known in the art. In another embodiment, the SELENBP1 protein is a homologue of a sequence set forth in one of the above GenBank entries. In another embodiment, the SELENBP1 protein is a variant of a sequence set forth in one of the above GenBank entries. In another embodiment, the SELENBP1 protein is an isomer of a sequence set forth in one of the above GenBank entries. In another embodiment, the SELENBP1 protein is a fragment of a sequence set forth in one of the above GenBank entries. In another embodiment, the SELENBP1 protein comprises a sequence set forth in one of the above GenBank entries. Each possibility represents a separate embodiment of the present invention.

The GPR161 protein targeted by methods and compositions of the present invention has, in another embodiment, the sequence:

(SEQ ID No: 314; GenBank Accession No. BC028163)
MSLNSSLSCRKELSNLTEEEGGEGGVIITQFIAIIVITIFVCLGNLVIVV

TLYKKSYLLTLSNKFVFSLTLSNFLLSVLVLPFVVTSSIRREWIFGVVWC

NFSALLYLLISSASMLTLGVIAIDRYYAVLYPMVYPMKITGNRAVMALVY

IWLHSLIGCLPPLFGWSSVEFDEFKWMCVAAWHREPGYTAFWQIWCALFP

FLVMLVCYGFIFRVARVKARKVHCGTVVIVEEDAQRTGRKNSSTSTSSSG

SRRNAFQGVVYSANQCKALITILVVLGAFMVTWGPYMVVIASEALWGKSS

VSPSLETWATWLSFASAVCHPLIYGLWNKTVRKELLGMCFGDRYYREPFV

QRQRTSRLFSISNRITDLGLSPHLTALMAGGQPLGHSSSTGDTGFSCSQD

SGTDMMLLEDYTSDDNPPSHCTCPPKRRSSVTFEDEVEQIKEAAKNSILH

VKAEVHKSLDSYAASLAKAIEAEAKINLFGEEALPGVLVTARTVPGGGFG

GRRGSRTLVSQRLQLQSIEEGDVLAAEQR.

In another embodiment, the GPR161 protein has an AA sequence set forth in one of the following GenBank entries: AK091271 and NM_153832. In another embodiment, the GPR161 protein is encoded by a gene having a nucleotide sequence set forth in one of the above GenBank entries. In another embodiment, the GPR161 protein is any other GPR161 protein known in the art. In another embodiment, the GPR161 protein is a homologue of a sequence set forth in one of the above GenBank entries. In another embodiment, the GPR161 protein is a variant of a sequence set forth in one of the above GenBank entries. In another embodiment, the GPR161 protein is an isomer of a sequence set forth in one of the above GenBank entries. In another embodiment, the GPR161 protein is a fragment of a sequence set forth in one of the above GenBank entries. In another embodiment, the GPR161 protein comprises a sequence set forth in one of the above GenBank entries. Each possibility represents a separate embodiment of the present invention.

The HEPH protein targeted by methods and compositions of the present invention has, in another embodiment, the sequence:

(SEQ ID No: 315; GenBank Accession No. BC011561)
MESGHLLWALLFMQSLWPQLTDGATRVYYLGIRDVQWNYAPKGRNVITNQ

PLDSDIVASSFLKSDKNRIGGTYKKTIYKEYKDDSYTDEVAQPAWLGFLG

PVLQAEVGDVILIHLKNFATRPYTIHPHGVFYEKDSEGSLYPDGSSGPLK

ADDSVPPGGSHIYNWTIPEGHAPTDADPACLTWIYHSHVDAPRDIATGLI

GPLITCKRGALDGNSPPQRQDVDHDFFLLFSVVDENLSWHLNENIATYCS

DPASVDKEDETFQESNRMHAINGFVFGNLPELNMCAQKRVAWHLFGMGNE

IDVHTAFFHGQMLTTRGHHTDVANIFPATFVTAEMVPWEPGTWLISCQVN

SHFRDGMQALYKVKSCSMAPPVDLLTGKVRQYFIEAHEIQWDYGPMGHDG

STGKNLREPGSISDKFFQKSSSRIGGTYWKVRYEAFQDETFQEKMHLEED

RHLGILGPVIRAEVGDTIQVVFYNRASQPFSMQPHGVFYEKDYEGTVYND

GSSYPGLVAKPFEKVTYRWTVPPHAGPTAQDPACLTWMYFSAADPIRDTN

SGLVGPLLVCRAGALGADGKQKGVDKEFFLLFTVLDENKSWYSNANQAAA

MLDFRLLSEDIEGFQDSNRMHAINGFLFSNLPRLDMCKGDTVAWHLLGLG

TETDVHGVMFQGNTVQLQGMRKGAAMLFPHTFVMAIMQPDNLGTFEIYCQ

AGSHREAGMRAIYNVSQCPGHQATPRQRYQAARIYYIMAEEVEWDYCPDR

SWEREWHNQSEKDSYGYIFLSNKDGLLGSRYKKAVFREYTDGTFRIPRPR

TGPEEHLGILGPLIKGEVGDILTVVFKNNASRPYSVHAHGVLESTTVWPL

AAEPGEVVTYQWNIPERSGPGPNDSACVSWIYYSAVDPIKDMYSGLVGPL

AICQKGILEPHGGRSDMDREFALLFLIFDENKSWYLEENVATHGSQDPGS

INLQDETFLESNKMHAINGKLYANLRGLTMYQGERVAWYMLAMGQDVDLH

TIHFHAESFLYRNGENYRADVVDLFPGTFEVVEMVASNPGTWLMHCHVTD

HVHAGMETLFTVFSRTEHLSPLTVITKETEKAVPPRDIEEGNVKMLGMQI

PIKNVEMLASVLVAISVTLLLVVLALGGVVWYQHRQRKLRRNRRSILDDS

FKLLSFKQ.

In another embodiment, the HEPH protein has an AA sequence set forth in one of the following GenBank entries: NM_138737, AF075034, AY358990, AB014598, AF148860, and NM_014799. In another embodiment, the HEPH protein is encoded by a gene having a nucleotide sequence set forth in one of the above GenBank entries. In another embodiment, the HEPH protein is any other HEPH protein known in the art. In another embodiment, the HEPH protein is a homologue of a sequence set forth in one of the above GenBank entries. In another embodiment, the HEPH protein is a variant of a sequence set forth in one of the above GenBank entries. In another embodiment, the HEPH protein is an isomer of a sequence set forth in one of the above GenBank entries. In another embodiment, the HEPH protein is a fragment of a sequence set forth in one of the above GenBank entries. In another embodiment, the HEPH protein comprises a sequence set forth in one of the above GenBank entries. Each possibility represents a separate embodiment of the present invention.

The FZD7 protein targeted by methods and compositions of the present invention has, in another embodiment, the sequence:

(SEQ ID No: 316; GenBank Accession No. AB017365)
MRDPGAAAPLSSLGLCALVLALLGALSAGAGAQPYHGEKGISVPDHGFCQ

PISIPLCTDIAYNQTILPNLLGHTNQEDAGLEVHQFYPLVKVQCSPELRF

FLCSMYAPVCTVLDQAIPPCRSLCERARQGCEALMNKFGFQWPERLRCEN

FPVHGAGEICVGQNTSDGSGGPGGGPTAYPTAPYLPDLPFTALPPGASDG

RGRPAFPFSCPRQLKVPPYLGYRFLGERDCGAPCEPGRANGLMYFKEEER

RFARLWVGVWSVLCCASTLFTVLTYLVDMRRFSYPERPIIFLSGCYFMVA

VAHVAGFLLEDRAVCVERFSDDGYRTVAQGTKKEGCTILFMVLYFFGMAS

SIWWVILSLTWFLAAGMKWGHEAIEANSQYFHLAAWAVPAVKTITILAMG

QVDGDLLSGVCYVGLSSVDALRGFVLAPLFVYLFIGTSFLLAGFVSLFRI

RTIMKHDGTKTEKLEKLMVRIGVFSVLYTVPATIVLACYFYEQAFREHWE

RTWLLQTCKSYAVPCPPGHFPPMSPDFTVFMIKYLMTMIVGITTGFWIWS

GKTLQSWRRFYHRLSHSSKGETAV.

In another embodiment, the FZD7 protein has an AA sequence set forth in one of the following GenBank entries: AL110146 and NM_003507. In another embodiment, the FZD7 protein is encoded by a gene having a nucleotide sequence set forth in one of the above GenBank entries. In another embodiment, the FZD7 protein is any other FZD7 protein known in the art. In another embodiment, the FZD7 protein is a homologue of a sequence set forth in one of the above GenBank entries. In another embodiment, the FZD7 protein is a variant of a sequence set forth in one of the above GenBank entries. In another embodiment, the FZD7 protein is an isomer of a sequence set forth in one of the above GenBank entries. In another embodiment, the FZD7 protein is a fragment of a sequence set forth in one of the above GenBank entries. In another embodiment, the FZD7 protein comprises a sequence set forth in one of the above GenBank entries. Each possibility represents a separate embodiment of the present invention.

The CLIC4 protein targeted by methods and compositions of the present invention has, in another embodiment, the sequence:

(SEQ ID No: 317; GenBank Accession No. NM_013943)
MALSMPLNGLKEEDKEPLIELFVKAGSDGESIGNCPFSQRLFMILWLKGV

VFSVTTVDLKRKPADLQNLAPGTHPPFITFNSEVKTDVNKIEEFLEEVLC

PPKYLKLSPKHPESNTAGMDIFAKFSAYIKNSRPEANEALERGLLKTLQK

LDEYLNSPLPDEIDENSMEDIKFSTRKFLDGNEMTLADCNLLPKLHIVKV

VAKKYRNFDIPKEMTGIWRYLTNAYSRDEFTNTCPSDKEVEIAYSDVAKR

LTK.

In another embodiment, the CLIC4 protein has an AA sequence set forth in one of the following GenBank entries: AL080061 and NM_001830. In another embodiment, the CLIC4 protein is encoded by a gene having a nucleotide sequence set forth in one of the above GenBank entries. In another embodiment, the CLIC4 protein is any other CLIC4 protein known in the art. In another embodiment, the CLIC4 protein is a homologue of a sequence set forth in one of the above GenBank entries. In another embodiment, the CLIC4 protein is a variant of a sequence set forth in one of the above GenBank entries. In another embodiment, the CLIC4 protein is an isomer of a sequence set forth in one of the above GenBank entries. In another embodiment, the CLIC4 protein is a fragment of a sequence set forth in one of the above GenBank entries. In another embodiment, the CLIC4 protein comprises a sequence set forth in one of the above GenBank entries. Each possibility represents a separate embodiment of the present invention.

In another embodiment, the present invention provides a method of treating an AGA in a subject, the method comprising the step of contacting the subject or the scalp thereof with a compound or composition that decreases an activity or level of a response to biotic stimulus protein, thereby treating an AGA in a subject.

"Response to biotic stimulus protein" refers, in another embodiment, to a protein classified as such based on Gene Ontology (GO) classifications. In another embodiment, the term refers to any other definition thereof known in the art. Each possibility represents a separate embodiment of the present invention.

In another embodiment, the present invention provides a method of treating an AGA in a subject, the method comprising the step of contacting the subject or the scalp thereof with a compound or composition that decreases an activity or level of a defense response protein, thereby treating an AGA in a subject.

"Defense response protein" refers, in another embodiment, to a protein classified as such based on Gene Ontology (GO) classifications. In another embodiment, the term refers to any other definition thereof known in the art. Each possibility represents a separate embodiment of the present invention.

In another embodiment, the present invention provides a method of treating an AGA in a subject, the method comprising the step of contacting the subject or the scalp thereof with a compound or composition that decreases an activity or level of an immune response protein, thereby treating an AGA in a subject.

In another embodiment, the present invention provides a method of treating an AGA in a subject, the method comprising the step of contacting the subject or the scalp thereof with an anti-inflammatory medication or compound, thereby treating an AGA in a subject. In another embodiment, the medication or compound is cyclosporine. In another embodiment, the medication or compound is prednisone. In another embodiment, the medication or compound is a topical calcineurin inhibitor. In another embodiment, the medication or compound is protopic. In another embodiment, the medication or compound is elidel. In another embodiment, the medication or compound is aspirin. In another embodiment, the medication or compound is any other anti-inflammatory medication or compound known in the art. Each possibility represents a separate embodiment of the present invention.

"Immune response protein" refers, in another embodiment, to a protein classified as such based on Gene Ontology (GO) classifications. In another embodiment, the term refers to any other definition thereof known in the art. Each possibility represents a separate embodiment of the present invention.

Figure 3D.5:
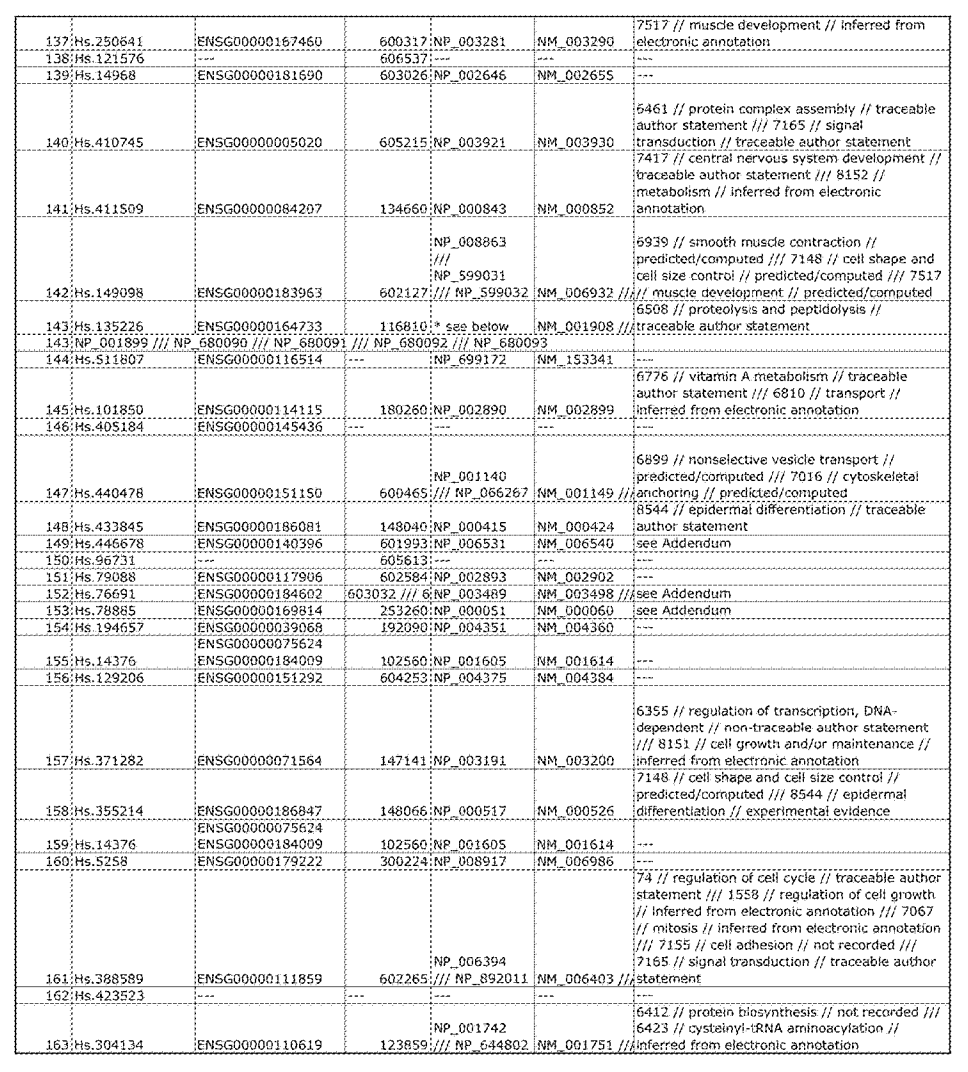

In another embodiment, the present invention provides a method of stimulating a hair growth in a subject, comprising the step of contacting the subject or the skin or scalp thereof with a compound or composition capable of increasing a level of a protein encoded by a gene shown in the present invention to be enriched in haired scalp, thereby stimulating a hair growth in a subject. In another embodiment, the gene is depicted in FIG. 3. Each possibility represents a separate embodiment of the present invention.

In another embodiment, the present invention provides a method of stimulating a hair growth in a subject, comprising the step of contacting the subject or the skin or scalp thereof with a compound or composition capable of increasing an activity of a protein encoded by a gene shown in the present invention to be enriched in haired scalp, thereby stimulating a hair growth in a subject. In another embodiment, the gene is depicted in FIG. 3. Each possibility represents a separate embodiment of the present invention.

In another embodiment, the present invention provides a method of treating acne in a skin of a subject, comprising the step of contacting the subject or the skin thereof with a compound or composition that inhibits a prostaglandin D2 activity in the skin, thereby treating acne in a skin of a subject.

In another embodiment, the present invention provides a method of treating acne in a skin of a subject, comprising the step of contacting the subject or the skin thereof with a compound or composition that inhibits a signaling or receptor pathway downstream of a prostaglandin D2 in the skin, thereby treating acne in a skin of a subject.

In another embodiment, the present invention provides a method of treating acne in a skin of a subject, comprising the step of contacting the subject or the skin thereof with a compound or composition that decreases a level of a prostaglandin D2 in the skin, thereby treating acne in a skin of a subject.

In another embodiment, the present invention provides a method of treating acne in a skin of a subject, comprising the step of contacting the subject or the skin thereof with a compound or composition that inhibits an activity of a PGD2S enzyme in the skin, thereby treating acne in a skin of a subject.

In another embodiment, the present invention provides a method of treating acne in a skin of a subject, comprising the step of contacting the subject or the skin thereof with a compound or composition that decreases a level of a prostaglandin D2 synthase enzyme in the skin, thereby treating acne in a skin of a subject.

In another embodiment, the present invention provides a method of treating acne in a skin of a subject, comprising the step of contacting the subject or the skin thereof with a compound or composition capable of decreasing an activity of a target gene of the present invention, thereby treating acne in a skin of a subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, and CORIN. Each possibility represents another embodiment of the present invention.

In another embodiment, the present invention provides a method of treating acne in a skin of a subject, comprising the step of contacting the subject or the skin thereof with a compound or composition capable of decreasing an expression of a target gene of the present invention, thereby treating acne in a skin of a subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, and CORIN. Each possibility represents another embodiment of the present invention.

In another embodiment, the acne that is treated by a method of present invention is androgen dependent. In another embodiment, the acne is associated with enlargement of the sebaceous glands. In another embodiment, the acne is associated with sebaceous gland hyperactivity. In another embodiment, the androgen-dependent effect results in both hair loss and sebaceous hyperplasia. In another embodiment, the androgen-dependent effect results in both hair loss and sebaceous gland hyperactivity. Each possibility represents a separate embodiment of the present invention.

In another embodiment, the present invention provides a method of treating rosacea in a skin of a subject, comprising the step of contacting the subject or the skin thereof with a compound or composition that inhibits a prostaglandin D2 activity in the skin, thereby treating rosacea in a skin of a subject.

In another embodiment, the present invention provides a method of treating rosacea in a skin of a subject, comprising the step of contacting the subject or the skin thereof with a compound or composition that inhibits a signaling or receptor pathway downstream of a prostaglandin D2 in the skin, thereby treating rosacea in a skin of a subject.

In another embodiment, the present invention provides a method of treating rosacea in a skin of a subject, comprising the step of contacting the subject or the skin thereof with a compound or composition that decreases a level of a prostaglandin D2 in the skin, thereby treating rosacea in a skin of a subject.

In another embodiment, the present invention provides a method of treating rosacea in a skin of a subject, comprising the step of contacting the subject or the skin thereof with a compound or composition that inhibits an activity of a PGD2S enzyme in the skin, thereby treating rosacea in a skin of a subject.

In another embodiment, the present invention provides a method of treating rosacea in a skin of a subject, comprising the step of contacting the subject or the skin thereof with a compound or composition that decreases a level of a prostaglandin D2 synthase enzyme in the skin, thereby treating rosacea in a skin of a subject.

In another embodiment, the present invention provides a method of treating rosacea in a skin of a subject, comprising the step of contacting the subject or the skin thereof with a compound or composition capable of decreasing an activity of a target gene of the present invention, thereby treating rosacea in a skin of a subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, and CORIN. Each possibility represents another embodiment of the present invention.

In another embodiment, the present invention provides a method of treating rosacea in a skin of a subject, comprising the step of contacting the subject or the skin thereof with a compound or composition capable of decreasing an expression of a target gene of the present invention, thereby treating rosacea in a skin of a subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, and CORIN. Each possibility represents another embodiment of the present invention.

In another embodiment, the present invention provides a method of treating rosacea in a skin of a subject, comprising the step of contacting the subject or the skin thereof with a compound or composition that decreases a level of a prostaglandin D2 synthase enzyme in the skin, thereby treating rosacea in a skin of a subject.

Methods for measuring sebaceous gland hypertrophy are well known in the art, and are described, for example, in Petersen M J et al (Development of a nude mouse model to study human sebaceous gland physiology and pathophysiology. J Clin Invest. 1984 October; 74(4):1358-65) and in Benavides F et al (Impaired hair follicle morphogenesis and cycling with abnormal epidermal differentiation in nackt mice, a cathepsin L-deficient mutation. Am J Pathol. 2002 August; 161(2):693-703). Each method represents a separate embodiment of the present invention.

In another embodiment, the rosacea that is treated by a method of present invention is androgen dependent. In another embodiment, the rosacea is associated with enlargement of the sebaceous glands. In another embodiment, the rosacea is associated with sebaceous gland hyperactivity. In another embodiment, the androgen-dependent effect results in both hair loss and flushing. In another embodiment, the androgen-dependent effect results in both hair loss and sebaceous hyperplasia. In another embodiment, the androgen-dependent effect results in both hair loss and sebaceous gland hyperactivity. Each possibility represents a separate embodiment of the present invention.

In another embodiment, the present invention provides a method of treating prostate cancer in a subject, comprising the step of contacting the subject with a compound or composition that inhibits a prostaglandin D2 activity in the prostate gland, thereby treating prostate cancer in a subject.

In another embodiment, the present invention provides a method of treating BPH in a subject, comprising the step of contacting the subject with a compound or composition that inhibits a prostaglandin D2 activity in the prostate gland, thereby treating prostate BPH in a subject.

In another embodiment, the present invention provides a method of treating prostate cancer in a subject, comprising the step of contacting the subject with a compound or composition that inhibits a signaling or receptor pathway downstream of a prostaglandin D2 in the prostate gland, thereby treating prostate cancer in a subject.

In another embodiment, the present invention provides a method of treating BPH in a subject, comprising the step of contacting the subject with a compound or composition that inhibits a signaling or receptor pathway downstream of a prostaglandin D2 in the prostate gland, thereby treating BPH in a subject.

In another embodiment, the present invention provides a method of treating prostate cancer in a subject, comprising the step of contacting the subject with a compound or composition that decreases a level of a prostaglandin D2 in the prostate gland, thereby treating prostate cancer in a subject.

In another embodiment, the present invention provides a method of treating BPH in a subject, comprising the step of contacting the subject with a compound or composition that decreases a level of a prostaglandin D2 in the prostate gland, thereby treating BPH in a subject.

In another embodiment, the present invention provides a method of treating prostate cancer in a subject, comprising the step of contacting the subject with a compound or composition that inhibits an activity of a PGD2S enzyme in the prostate gland, thereby treating prostate cancer in a subject.

In another embodiment, the present invention provides a method of treating BPH in a subject, comprising the step of contacting the subject with a compound or composition that inhibits an activity of a PGD2S enzyme in the prostate gland, thereby treating BPH in a subject.

In another embodiment, the prostate cancer or BPH that is treated by a method of present invention is androgen dependent. In another embodiment, the androgen-dependent effect results in prostate cancer or BPH. In another embodiment, the androgen-dependent effect results in prostate cancer. In another embodiment, the androgen-dependent effect results in BPH. Each possibility represents a separate embodiment of the present invention.

In another embodiment, the present invention provides a method of suppressing fertility of a male subject, comprising the step of contacting the subject with a compound or composition that inhibits a prostaglandin D2 activity in the testes, thereby suppressing fertility of a male subject.

In another embodiment, the present invention provides a method of suppressing fertility of a male subject, comprising the step of contacting the subject with a compound or composition that inhibits a signaling or receptor pathway downstream of a prostaglandin D2 in the testes, thereby suppressing fertility of a male subject.

In another embodiment, the present invention provides a method of suppressing fertility of a male subject, comprising the step of contacting the subject with a compound or composition that decreases a level of a prostaglandin D2 in the testes, thereby suppressing fertility of a male subject.

In another embodiment, the present invention provides a method of suppressing fertility of a male subject, comprising the step of contacting the subject with a compound or composition that inhibits an activity of a PGD2S enzyme in the testes, thereby suppressing fertility of a male subject.

In another embodiment, the present invention provides a method of suppressing fertility of a male subject, comprising the step of contacting the subject with a compound or composition that decreases a level of a prostaglandin D2 synthase enzyme in the testes, thereby suppressing fertility of a male subject.

In another embodiment, the present invention provides a method of suppressing fertility of a male subject, comprising the step of contacting the subject with a compound or composition capable of decreasing an activity of a target gene of the present invention, thereby suppressing fertility of a male subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, and CORIN. Each possibility represents another embodiment of the present invention.

In another embodiment, the present invention provides a method of suppressing fertility of a male subject, comprising the step of contacting the subject with a compound or composition capable of decreasing an expression of a target gene of the present invention, thereby suppressing fertility of a male subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, and CORIN. Each possibility represents another embodiment of the present invention.

In another embodiment, the present invention provides a method of suppressing fertility of a male subject, comprising the step of contacting the subject with a compound or composition that decreases a level of a prostaglandin D2 synthase enzyme in the testes, thereby suppressing fertility of a male subject.

In another embodiment, the fertility that is suppressed by a method of present invention is dependent on expression of PGD2 by Leydig cells. In another embodiment, the expression of PGD2 is androgen dependent. Each possibility represents a separate embodiment of the present invention.

In another embodiment, the present invention provides a method of stimulating a hair growth in a subject, comprising the step of contacting the subject or the skin or scalp thereof with a compound or composition capable of decreasing an activity of a target gene of the present invention, thereby stimulating a hair growth in a subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, and CORIN. Each possibility represents another embodiment of the present invention.

In another embodiment, the present invention provides a method of stimulating a hair growth in a subject, comprising the step of contacting the subject or the skin or scalp thereof with a compound or composition capable of decreasing an expression of a target gene of the present invention, thereby stimulating a hair growth in a subject. In another embodiment, the gene is selected from CCL18, Col11A1, Col3A1, CD4, Cd1a, FCER1A, HLA-C, and HLA-DPA1. In another embodiment, the gene is selected from IGF1, GPR105, PDGFRL, ADRA2A, CCL19, and CORIN. Each possibility represents another embodiment of the present invention.

In another embodiment, the target gene is CCL18. In another embodiment, the target gene is Col11A1. In another embodiment, the target gene is Col3A1. In another embodiment, the target gene is CD4. In another embodiment, the target gene is Cd1a. In another embodiment, the target gene is FCER1A. In another embodiment, the target gene is HLA-C. In another embodiment, the target gene is HLA-DPA1. In another embodiment, the target gene is IGF1. In another embodiment, the target gene is GPR105. In another embodiment, the target gene is PDGFRL. In another embodiment, the target gene is ADRA2A. In another embodiment, the target gene is CCL19. In another embodiment, the target gene is PTGD2. In another embodiment, the target gene is CORIN. Each possibility represents a separate embodiment of the present invention.

In another embodiment, a compound or composition utilized in a method or composition of the present invention negatively regulates expression of the gene encoding the target protein. In another embodiment, the compound or composition negatively regulates transcription of the gene encoding the target protein. In another embodiment, the compound or composition negatively regulates translation of an RNA molecule encoding the target protein. In another embodiment, the compound or composition negatively regulates expression of the target protein in a post-translational fashion. Each possibility represents a separate embodiment of the present invention.

As provided herein, findings of the present invention demonstrate that various target genes (e.g. CCL18, Col11A1, Col3A1, CD4, Cd1a, FCER1A, HLA-C, HLA-DPA1, IGF1, GPR105, PDGFRL, ADRA2A, CCL19, PTGD2, and CORIN) are up-regulated in bald scalp. Thus, decreasing expression or activity of products of these genes in bald scalp will stimulate hair growth. In another embodiment, the target gene is CCL18. In another embodiment, the target gene is Col11 A1. In another embodiment, the target gene is Col3A1. In another embodiment, the target gene is CD4. In another embodiment, the target gene is Cd1a. In another embodiment, the target gene is FCER1A. In another embodiment, the target gene is HLA-C. In another embodiment, the target gene is HLA-DPA1. In another embodiment, the target gene is any of the genes shown in FIG. 3 to be enriched in bald scalp. Each possibility represents a separate embodiment of the present invention.

The CCL18 protein targeted by methods and compositions of the present invention has, in another embodiment, the sequence:

(SEQ ID No: 259)
MKGLAAALLVLVCTMALCSCAQVGTNKELCCLVYTSWQIPQKFIVDYSET

SPQCPKPGVILLTKRGRQICADPNKKWVQKYISDLKLNA.

In another embodiment, the CCL18 protein has an AA sequence set forth in one of the following GenBank entries: NM_002988, Y13710, BC069700, BC096124, BC096125, BC096126, BC096127, AB000221, and CR407660. In another embodiment, the CCL18 protein is encoded by a gene having a nucleotide sequence set forth in one of the above GenBank entries. In another embodiment, the CDL18 protein is a homologue of a sequence set forth in one of the above GenBank entries. In another embodiment, the CDL18 protein is a variant of a sequence set forth in one of the above GenBank entries. In another embodiment, the CDL18 protein is an isomer of a sequence set forth in one of the above GenBank entries. In another embodiment, the CDL18 protein is a fragment of a sequence set forth in one of the above GenBank entries. In another embodiment, the CDL18 protein comprises a sequence set forth in one of the above GenBank entries. Each possibility represents a separate embodiment of the present invention.

The Col11A1 protein targeted by methods and compositions of the present invention has, in another embodiment, the sequence:

(SEQ ID No: 260)
MFSFVDLRLLLLLAATALLTHGQEEGQVEGQDEDIPPITCVQNGLRYHDR

DVWKPEPCRICVCDNGKVLCDDVICDETKNCPGAEVPEGECCPVCPDGSE

SPTDQETTGVEGPKGDTGPRGPRGPAGPPGRDGIPGQPGLPGPPGPPGPP

GPPGLGGNFAPQLSYGYDEKSTGGISVPGPMGPSGPRGLPGPPGAPGPQG

FQGPPGEPGEPGASGPMGPRGPPGPPGKNGDDGEAGKPGRPGERGPPGPQ

GARGLPGTAGLPGMKGHRGFSGLDGAKGDAGPAGPKGEPGSPGENGAPGQ

MGPRGLPGERGRPGAPGPAGARGNDGATGAAGPPGPTGPAGPPGFPGAVG

AKGEAGPQGPRGSEGPQGVRGEPGPPGPAGAAGPAGNPGADGQPGAKGAN

GAPGIAGAPGFPGARGPSGPQGPGGPPGPKGNSGEPGAPGSKGDTGAKGE

PGPVGVQGPPGPAGEEGKRGARGEPGPTGLPGPPGERGGPGSRGFPGADG

```
VAGPKGPAGERGSPGPAGPKGSPGEAGRPGEAGLPGAKGLTGSPGSPGPD

GKTGPPGPAGQDGRPGPPGPPGARGQAGVMGFPGPKGAAGEPGKAGERGV

PGPPGAVGPAGKDGEAGAQGPPGPAGPAGERGEQGPAGSPGFQGLPGPAG

PPGEAGKPGEQGVPGDLGAPGPSGARGERGFPGERGVQGPPGPAGPRGAN

GAPGNDGAKGDAGAPGAPGSQGAPGLQGMPGERGAAGLPGPKGDRGDAGP

KGADGSPGKDGVRGLTGPIGPPGPAGAPGDKGESGPSGPAGPTGARGAPG

DRGEPGPPGPAGFAGPPGADGQPGAKGEPGDAGAKGDAGPPGPAGPAGPP

GPIGNVGAPGAKGARGSAGPPGATGFPGAAGRVGPPGPSGNAGPPGPPGP

AGKEGGKGPRGETGPAGRPGEVGPPGPPGPAGEKGSPGADGPAGAPGTPG

PQGIAGQRGVVGLPGQRGERGFPGLPGPSGEPGKQGPSGASGERGPPGPM

GPPGLAGPPGESGREGAPGAEGSPGRDGSPGAKGDRGETGPAGPPGAPGA

PGAPGPVGPAGKSGDRGETGPAGPAGPVGPVGARGPAGPQGPRGDKGETG

EQGDRGIKGHRGFSGLQGPPGPPGSPGEQGPSGASGPAGPRGPPGSAGAP

GKDGLNGLPGPIGPPGPRGRTGDAGPVGPPGPPGPPGPPGPPSAGFDFSF

LPQPPQEKAHDGGRYYRADDANVVRDRDLEVDTTLKSLSQQIENIRSPEG

SRKNPARTCRDLKMCHSDWKSGEYWIDPNQGCNLDAIKVFCNMETGETCV

YPTQPSVAQKNWYISKNPKDKRHVWFGESMTDGFQFEYGGQGSDPADVAI

QLTFLRLMSTEASQNITYHCKNSVAYMDQQTGNLKKALLLQGSNEIEIRA

EGNSRFTYSVTVDGCTSHTGAWGKTVIEYKTTKTSRLRIIDVAPLDVGAP

DQEFGFDVGHVCFL.
```

In another embodiment, the Col11 A1 protein has an AA sequence set forth in one of the following GenBank entries: BC036531, M32798, NM_000088, K01228, M32798, J00110, J00111, J00112, J00113, M36546, S64596, BC036531, AB209597, X06269, X07884, and Z74615. In another embodiment, the Col11A1 protein is encoded by a gene having a nucleotide sequence set forth in one of the above GenBank entries. In another embodiment, the Col11 A1 protein is a homologue of a sequence set forth in one of the above GenBank entries. In another embodiment, the Col11A1 protein is a variant of a sequence set forth in one of the above GenBank entries. In another embodiment, the Col11A1 protein is an isomer of a sequence set forth in one of the above GenBank entries. In another embodiment, the Col11A1 protein is a fragment of a sequence set forth in one of the above GenBank entries. In another embodiment, the Col11A1 protein comprises a sequence set forth in one of the above GenBank entries. Each possibility represents a separate embodiment of the present invention Each possibility represents a separate embodiment of the present invention.

The Col3A1 protein targeted by methods and compositions of the present invention has, in another embodiment, the sequence:

```
                                          (SEQ ID No: 261)
MMSFVQKGSWLLLALLHPTIILAQQEAVEGGCSHLGQSYADRDVWKPEPC

QICVCDSGSVLCDDIICDDQELDCPNPEIPFGECCAVCPQPPTAPTRPPN

GQGPQGPKGDPGPPGIPGRNGDPGIPGQPGSPGSPGPPGICESCPTGPQN

YSPQYDSYDVKSGVAVGGLAGYPGPAGPPGPPGPPGTSGHPGSPGSPGYQ

GPPGEPGQAGPSGPPGPPGAIGPSGPAGKDGESGRPGRPGERGLPGPPGI

KGPAGIPGFPGMKGHRGFDGRNGEKGETGAPGLKGENGLPGENGAPGPMG

PRGAPGERGRPGLPGAAGARGNDGARGSDGQPGPPGPPGTAGFPGSPGAK

GEVGPAGSPGSNGAPGQRGEPGPQGHAGAQGPPGPPGINGSPGGKGEMGP

AGIPGAPGLMGARGPPGPAGANGAPGLRGGAGEPGKNGAKGEPGPRGERG

EAGIPGVPGAKGEDGKDGSPGEPGANGLPGAAGERGAPGFRGPAGPNGIP

GEKGPAGERGAPGPAGPRGAAGEPGRDGVPGGPGMRGMPGSPGGPGSDGK

PGPPGSQGESGRPGPPGPSGPRGQPGVMGFPGPKGNDGAPGKNGERGGPG

GPGPQGPPGKNGETGPQGPPGPTGPGGDKGDTGPPGPQGLQGLPGTGGPP

GENGKPGEPGPKGDAGAPGAPGGKGDAGAPGERGPPGLAGAPGLRGGAGP

PGPEGGKGAAGPPGPPGAAGTPGLQGMPGERGGLGSPGPKGDKGEPGGPG

ADGVPGKDGPRGPTGPIGPPGPAGQPGDKGEGGAPGLPGIAGPRGSPGER

GETGPPGPAGFPGAPGQNGEPGGKGERGAPGEKGEGGGPPGVAGPPGKDGT

SGHPGPIGPPGPRGNRGERGSEGSPGHPGQPGPPGPPGAPGPCCGGVGAA

AIAGIGGEKAGGFAPYYGDEPMDFKINTDEIMTSLKSVNGQIESLISPDG

SRKNPARNCRDLKFCHPELKSGEYWVDPNQGCKLDAIKVFCNMETGETCI

SANPLNVPRKHWWTDSSAEKKHVWFGESMDGGFQFSYGNPELPEDVLDVQ

LAFLRLLSSRASQNITYHCKNSIAYMDQASGNVKKALKLMGSNEGEFKAE

GNSKFTYTVLEDGCTKHTGEWSKTVFEYRTRKAVRLPIVDIAPYDIGGPD

QEFGVDVGPVCFL.
```

In another embodiment, the Col3A1 protein has an AA sequence set forth in one of the following GenBank entries: BC028178, AK091853, NM_000090, M13146, M11134, S79877, M59227, BC028178, X01655, X01742, X07240, X14420, and X15332. In another embodiment, the Col3A1 protein is encoded by a gene having a nucleotide sequence set forth in one of the above GenBank entries. In another embodiment, the Col3A2 protein is a homologue of a sequence set forth in one of the above GenBank entries. In another embodiment, the Col3A2 protein is a variant of a sequence set forth in one of the above GenBank entries. In another embodiment, the Col3A2 protein is an isomer of a sequence set forth in one of the above GenBank entries. In another embodiment, the Col3A2 protein is a fragment of a sequence set forth in one of the above GenBank entries. In another embodiment, the Col3A2 protein comprises a sequence set forth in one of the above GenBank entries. Each possibility represents a separate embodiment of the present invention.

The CD4 protein targeted by methods and compositions of the present invention has, in another embodiment, the sequence:

```
                                          (SEQ ID No: 262)
MNRGVPFRHLLLVLQLALLPAATQGKKVVLGKKGDTVELTCTASQKKSIQ

FHWKNSNQIKILGNQGSFLTKGPSKLNDRADSRRSLWDQGNFPLIIKNLK

IEDSDTYICEVEDQKEEVQLLVFGLTANSDTHLLQGQSLTLTLESPPGSS

PSVQCRSPRGKNIQGGKTLSVSQLELQDSGTWTCTVLQNQKKVEFKIDIV

VLAFQKASSIVYKKEGEQVEFSFPLAFTVEKLTGSGELWWQAERASSSKS
```

-continued

WITFDLKNKEVSVKRVTQDPKLQMGKKLPLHLTLPQALPQYAGSGNLTLA

LEAKTGKLHQEVNLVVMRATQLQKNLTCEVWGPTSPKLMLSLKLENKEAK

VSKREKAVWVLNPEAGMWQCLLSDSGQVLLESNIKVLPTWSTPVQPMALI

VLGGVAGLLLFIGLGIFFCVRCRHRRRQAERMSQIKRLLSEKKTCQCPHR

FQKTCSPI.

In another embodiment, the CD4 protein has an AA sequence set forth in one of the following GenBank entries: NM_000616, DQ012936, BT019811, BT019791, DQ012936, AAY22175, M35160, AAA16069, U47924, AAB51309, X87579, CAA60883, BC025782, AAH25782, BT019791, AAV38594, BT019811, AAV38614, DA463597, DB123455, M12807, AAA35572, S79267, AAB35273, U40625, AAB02789. In another embodiment, the CD4 protein is encoded by a gene having a nucleotide sequence set forth in one of the above GenBank entries. In another embodiment, the CD4 protein is encoded by a gene at the location 12pter-p12. In another embodiment, the CD4 protein is a homologue of a sequence set forth in one of the above GenBank entries. In another embodiment, the CD4 protein is a variant of a sequence set forth in one of the above GenBank entries. In another embodiment, the CD4 protein is an isomer of a sequence set forth in one of the above GenBank entries. In another embodiment, the CD4 protein is a fragment of a sequence set forth in one of the above GenBank entries. In another embodiment, the CD4 protein comprises a sequence set forth in one of the above GenBank entries. Each possibility represents a separate embodiment of the present invention.

The Cd1a protein targeted by methods and compositions of the present invention has, in another embodiment, the sequence:

(SEQ ID No: 263)
ADGLKEPLSFHVTWIASFYNHSWKQNLVSGWLSDLQTHTWDSNSSTIVFL

CPWSRGNFSNEEWKELETLFRIRTIRSFEGIRRYAHELQFE.

In another embodiment, the Cd1a protein has an AA sequence set forth in one of the following GenBank entries: AF142665, AAD37578, AL121986, CAI10848, M14663, AAA51934, M22167, AAA51932, BC031645, AAH31645, CR603267, M27735, AAA51933, M28825, AAA51931, X04450, and CAA28049. In another embodiment, the Cd1a protein is encoded by a gene having a nucleotide sequence set forth in one of the above GenBank entries. Each possibility represents a separate embodiment of the present invention. In another embodiment, the Cd1a protein is a homologue of a sequence set forth in one of the above GenBank entries. In another embodiment, the Cd1a protein is a variant of a sequence set forth in one of the above GenBank entries. In another embodiment, the Cd1a protein is an isomer of a sequence set forth in one of the above GenBank entries. In another embodiment, the Cd1a protein is a fragment of a sequence set forth in one of the above GenBank entries. In another embodiment, the Cd1a protein comprises a sequence set forth in one of the above GenBank entries. Each possibility represents a separate embodiment of the present invention.

The FCER1A protein targeted by methods and compositions of the present invention has, in another embodiment, the sequence:

(SEQ ID No: 264)
MAPAMESPTLLCVALLFFAPDGVLAVPQKPKVSLNPPWNRIFKGENVTLT

CNGNNFFEVSSTKWFHNGSLSEETNSSLNIVNAKFEDSGEYKCQHQQVNE

SEPVYLEVFSDWLLLQASAEVVMEGQPLFLRCHGWRNWDVYKVIYYKDGE

ALKYWYENHNISITNATVEDSGTYYCTGKVWQLDYESEPLNITVIKAPRE

KYWLQFFIPLLVVILFAVDTGLFISTQQQVTFLLKIKRTRKGFRLLNPHP

KPNPKNN.

In another embodiment, the FCER1A protein has an AA sequence set forth in one of the following GenBank entries: A21606, CAA01564, AB059236, BAB84120, L14075, AAA16115, BC005912, AAH05912, BC015185, BC015195, AAH15195, J03605, AAA36204, X06948, and CAA30025. In another embodiment, the FCER1A protein is encoded by a gene having a nucleotide sequence set forth in one of the above GenBank entries. In another embodiment, the FCER1A protein has an AA or nucleotide sequence set forth in a GenBank entry for a FCE1A protein. In another embodiment, the FCER1A protein has an AA or nucleotide sequence set forth in a GenBank entry for a FcERI protein. Each possibility represents a separate embodiment of the present invention. In another embodiment, the FCER1A protein is a homologue of a sequence set forth in one of the above GenBank entries. In another embodiment, the FCER1A protein is a variant of a sequence set forth in one of the above GenBank entries. In another embodiment, the FCER1A protein is an isomer of a sequence set forth in one of the above GenBank entries. In another embodiment, the FCER1A protein is a fragment of a sequence set forth in one of the above GenBank entries. In another embodiment, the FCER1A protein comprises a sequence set forth in one of the above GenBank entries. Each possibility represents a separate embodiment of the present invention.

The HLA-C protein targeted by methods and compositions of the present invention has, in another embodiment, the sequence:

(SEQ ID No: 265)
SHSMRYFDTAVSRPGRGEPRFISVGYVDDTQFVRFDSDAASPRGEPRAPW

VEQEGPEYWDRETQKYKRQAQADRVNLRKLRGYYNQSEDGSHTLQWMYGC

DLGPDGRLLRGYDQSAYDGKDYIALNEDLRSWTAADTAAQITQRKWEAAR

EAEQLRAYLEGTCVEWLRRYLENGKETLQRA.

In another embodiment, the HLA-C protein has an AA sequence set forth in one of the following GenBank entries: AB008136, BAA22919, AB032096, BAA84115, AB088111, BAC54942, AB196344, BAD77815, AB196345, BAD77816, AB196346, BAD77817, AB202106, BAE78631, AB247153, BAE76021, AB247154, BAE76022, AF002270, AAC14581, AF002271, AAB62539, AF003284, AAC17716, AF009682, AAB66708, AF009684, AAB66710, AF009685, AAB66711, AF015557, AAC17722, AF015559, AAC17724, AF016304, AAB80724, AF017322, AAB70288, AF017323, AAB70289, AF017324, AAB70290, AF017325, AAB70291, AF017326, AAB70292, AF017329, AAB70295, AF017330, AAB70296, AF017331, AAC14579, AF019568, AAC17721, AF036551, AAC17727, AF036553, AAC17725, AF036555, AAC17713, AF036557, AAC17720, AF037075, AAC17717, AF037077, AAC17718, AF037079, AAC17715, AF037450, AAC17710, AF038574, AAC17723, AF039198, AAD37816, AF062587, AAC16245, AF062588, AAC16245, AF069961, AAF23073, AF076476, AAC27626, AF082801, AAD52014, AF100320, AAF04638, AF102689, AAF04743, AF105241, AAF29567, AF138277, AAF64391, AF139728, AAF65514, AF144665, AAD38379, AF145467, AAD38672, AF145761, AAD38673, AF145763, AAD38674, AF147702, AAD53513, AF165851, AAF89551, AF165853, AAF89554, AF172868, AAD48066, AF176082, AAD51747, AF179632, AAD52687, AF189726, AAF04581, AF205537, AAF19427, AF220291, AAF33239, AF245437, AAG53741, AF250557, AAG53742, AF281056, AAK69510, AF284583, AAF91475, AF289031, AAG10048, AF316036, AAG49322, AF323844, AAG40881, AF323846, AAG40882, AF323854, AAG42272, AF335315, AAK07655, AF480614, AAL87225, AF497547, AAM46846, AF509727, AAP30863, AF510721, AAM44831, AF525406, AAM83098, AF525408, AAM91947, AF529191, AAN04004, AF535212, AAN07187, AF539619, AAN33107, AF541997, AAN10165, AF541998, AAN10166, AJ001977, CAA05125, AJ010322, CAB45917, AJ010323, CAB45918, AJ011881, CAB65545, AJ011882, CAB65546, AJ011883, CAB65547, AJ011884, CAB65548, AJ131194, CAC11132, AJ133100, CAB38942, AJ133473, CAB37942, AJ133475, CAB37944, AJ133476, CAB37945, AJ237703, CAB40352, AJ238694, CAB41889, AJ242661, CAB44356, AJ243434, CAB46485, AJ249163, CAB53538, AJ249164, CAB53539, AJ277100, CAB86064, AJ278494, CAB95011, AJ278509, CAC01936, AJ291815, CAC19191, AJ292559, CAC05372, AJ293016, CAC04321, AJ293017, CAC04322, AJ293511, CAB97130, AJ298116, CAC18746, AJ298837, CAC12745, AJ300765, CAC24483, AJ304496, CAC19018, AJ306617, CAC36100, AJ318865, CAC79613, AJ418708, CAD12801, AJ420242, CAD12427, AJ420243, CAD12428, AJ420245, CAD12430, AJ420247, CAD12432, AJ420248, CAD12433, AJ420251, CAD12436, AJ420252, CAD12437, AJ438882, CAD27616, AJ440717, CAD29450, AJ440718, CAD29451, AJ506097, CAD44569, AJ506196, CAD44641, AJ507389, CAD45440, AJ507431, CAD45557, AJ507797, CAD47827, AJ507798, CAD47856, AJ515217, CAD56468, AJ535690, CAD59685, AJ549184, CAD70710, AJ549185, CAD70711, AJ550622, CAD79471, AJ550623, CAD79472, AJ558126, CAD90006, AJ558127, CAD90007, AJ558128, CAD90008, AJ558129, CAD90009, AJ558130, CAD90010, AJ558132, CAD90012, AJ566950, CAD98751, AJ579644, CAE22463, AJ579645, CAE22464, AJ579646, CAE22465, AJ579787, CAE30287, AJ579997, CAE30455, AJ579998, CAE30456, AJ580001, CAE30459, AJ580002, CAE30460, AJ616764, CAE84097, AJ616766, CAE84099, AJ616770, CAE84103, AJ616772, CAE84105, AJ616774, CAE84107, AJ617511, CAE85468, AJ617512, CAE85469, AJ617783, CAE92337, AJ617785, CAE92338, AJ620461, CAF05030, AJ621024, CAF18233, AJ628733, CAF32225, AJ628735, CAF32226, AJ628737, CAF32227, AJ628741, CAF32229, AJ629313, CAF33342, AJ629315, CAF33343, AJ635295, CAG25672, AJ635299, CAG25674, AJ697649, CAG26752, AJ697650, CAG26753, AJ697852, CAG26974, AJ810176, CAH17687, AJ831405, CAH40829, AJ851863, CAH65480, AJ851864, CAH65479, AJ851865, CAH65478, AJ865388, CAI29271, AJ871635, CAI40345, AJ879943, CAI53896, AJ971029, CAI94871, AL662833, CAI17409, AL671883, CAI18144, AM039493, CAJ01384, AM087019, CAJ31318, AM087957, CAJ32664, AM087958, CAJ32665, AM157129, CAJ42902, AM180629, CAJ55687, AM180647, CAJ55680, AM180648, CAJ55681, AM180649, CAJ55682, AM180651, CAJ55690, AM180722, CAJ55741, AM180941, CAJ56101, AY028706, AAK31618, AY028708, AAK31619, AY064404, AAL49978, AY078079, AAL82717, AY093610, AAM14725, AY158888, AA049822, AY162385, AAN84536, AY181042, AA024136, AY217669, AA062346, AY229982, AA074627, AY230857, AA073564, AY233979, AA084019, AY323834, AAP84346, AY354908, AAR28201, AY363885, AAR19086, AY363887, AAR19102, AY364410, AAR15062, AY368486, AAR28679, AY368504, AAQ72735, AY371078, AAR15147, AY371080, AAR15148, AY373452, AAQ81571, AY429571, AAR06856, AY429604, AAR08453, AY429725, AAR10880, AY429727, AAR10881, AY434500, AAR12134, AY438570, AAR06668, AY438572, AAR06669, AY484703, AAR87009, AY509614, AAR99590, AY509615, AAR99591, AY509618, AAR99594, AY530953, AAS98883, AY536515, AAS45436, AY607028, AAT46360, AY618875, AAT39426, AY619989, AAT41622, AY623606, AAT39989, AY643837, AAT65966, AY714373, AAU14145, AY839182, AAW21339, AY887667, AAW88385, AY918170, AAX18631, AY918171, AAX18632, AY929155, AAX98239, AY973960, AAX94769, AY973961, AAX94770, BA000025, BAB63310, D64153, BAA11022, D83957, BAA22206, D89334, BAA13946, DQ003053, AAY23010, DQ020591, AAY46194, DQ086795, AAZ28915, DQ086799, AAZ28917, DQ135946, AAZ53371, DQ135948, AAZ53372, DQ244128, ABB52621, DQ244130, ABB52622, DQ244132, ABB52623, DQ244134, ABB52624, DQ270211, ABB55457, DQ289052, ABC02064, DQ289054, ABC02065, DQ327710, ABC59292, DQ334740, ABC61964, DQ334744, ABC61966, DQ359691, ABD60574, DQ400515, ABD62869, DQ400525, ABD62874, DQ400527, ABD62875, DQ400531, ABD62877, L54059, AAB04639, M16272, AAA59700, M16273, AAA59702, M24030, AAA59671, M26432, AAA59648, M28172, AAA59670, M59865, AAA59659, U31373, AAA74583, U38975, AAA81370, U38976, AAA81371, U44064, AAB02773, U52216, AAB82334, U56260, AAB01210, U60217, AAB03578, U60218, AAB03579, U60321, AAB03581, U60322, AAB03582, U60323, AAB03583, U60324, AAB03584, U60422, AAB03587, U61273, AAB03623, U61274, AAB03624, U80671, AAB38971, U81012, AAB40998, U88251, AAB48495, U88252, AAB48496, U88253, AAB48497, U88839, AAB48516, U96785, AAC17737, U96787, AAC17719, U96789, AAC17728, U97345, AAC17714, U97347, AAC17711, X00495, CAA25190, Y14684, CAA75000, Y15745, CAA75755, Y15746, CAA75756, Y15842, CAB44777, Y16411, CAA76197, Y16412, CAA76198, Y16418, CAA76206, Y17064, CAA76613, Y17065, CAA76614, Y18139, CAB71932, Y18141, CAB71934, Y18142, CAB71935, Y18143, CAB71936, Y18145, CAB71938, Y18146, CAB71939, Y18499, CAB71315, Y18656, CAB71940, Z22752, CAA80437, Z72007, CAA96520, Z75172, CAA99487, Z79751, CAB02077, Z80228, CAB02409, AF196489, AAM76870, AF405691, AAL03994, AJ005199, CAA06438, AJ010749, CAA09341, AJ440716, CAD29433, AJ537578, CAD61205, AK024836, AK130592, AY732487, AAV33126, BC002463, AAH02463, BC004489, BC007814, AAH07814, BC008457, AAH08457, BC010542, AAH10542, BC033293, AAH33293, BC041078, CA395932, CR590624, CR591580, CR592947, CR593350, CR595198, CR596955, CR597526, CR598290, CR598918, CR599470, CR600524, CR601147, CR602127, CR602442, CR603910, CR604220, CR605658, CR606564, CR606802, CR606838, CR607146, CR607446, CR607744, CR608009, CR608133, CR608445, CR608734, CR610206, CR610282, CR610894, CR611167, CR611253, CR611808, CR612894, CR613417, CR617532, CR619374, CR619491, CR619732, CR620918, CR622501, CR623932, CR625377, CR626083, CR626476, CR626681, D38526, BAA07531, D49552, BAA08500, D49819, BAA08625, D50852, BAA32611, D50853, BAA32610, D50854, BAA32612, D64145, BAA19531, D64146, BAA19532, D64147, BAA19533, D64150, BAA19535, D64151, BAA19536, D64152, BAA19537, D83029, BAA11747, D83030, BAA32613, D83741, BAA32615, L38251, AAF26750, L77114, AAL40067, M11886, AAA52665, M12679, AAA59699, M21963, AAA59847, M24031, AAA00027, M24096, AAA59654, M24097, AAA59656, AAA59657, M24097, AAA59656, AAA59657, M26429, AAA59701, M26430, AAA59703, M26431, AAA59704, M26712, AAA52666, M28160, AAA36235, M28206, AAA57258, M28207, AAA53259, M84171, AAA59685, M84172, AAA59686, M84386, AAA59705, M99389, AAA88088, M99390, AAA88089, S74115, AAD14147, U06695, AAA92995, U06696, AAA92996, U07230, AAA17037, U09853, AAA50217, U41386, AAC32743, U41420, AAC32742, U62824, AAB67322, X58536, CAA41427, X70856, CAA50209, X70857, CAA50210, X76189, CAA53783, X82122, CAA57634, X83394, CAA58313, X97321, CAA65986, X98742, CAA67294, X99704, CAA68035, Y10520, CAA71531, Y11843, CAA72592, Z33459, CAA83881, Z46809, CAA86839, Z46810, CAA86840, Z83247, and CAB05845. In another embodiment, the HLA-C protein is encoded by a gene having a nucleotide sequence set forth in one of the above GenBank entries. In another embodiment, the HLA-C protein has an AA or nucleotide sequence set forth in a GenBank entry for a Cw*1701 protein. In another embodiment, the HLA-C protein has an AA or nucleotide sequence set forth in a GenBank entry for a D6S204 protein. In another embodiment, the HLA-C protein has an AA or nucleotide sequence set forth in a GenBank entry for a FLJ27082 protein. In another embodiment, the HLA-C protein has an AA or nucleotide sequence set forth in a GenBank entry for a HLA-JY3 protein. In another embodiment, the HLA-C protein has an AA or nucleotide sequence set forth in a GenBank entry for a HLC-C protein. In another embodiment, the HLA-C protein is a homologue of a sequence set forth in one of the above GenBank entries. In another embodiment, the HLA-C protein is a variant of a sequence set forth in one of the above GenBank entries. In another embodiment, the HLA-C protein is an isomer of a sequence set forth in one of the above GenBank entries. In another embodiment, the HLA-C protein is a fragment of a sequence set forth in one of the above GenBank entries. In another embodiment, the HLA-C protein comprises a sequence set forth in one of the above GenBank entries. Each possibility represents a separate embodiment of the present invention.

The HLA-DPA1 protein targeted by methods and compositions of the present invention has, in another embodiment, the sequence:

(SEQ ID No: 266)
TFCRVFLYFLYAADHVSTYAMFVQTHRPTGEFMFEFDEDEMFYVDLDKKE

TVWHLEEFGQAFSFEAQGGLANIAILNNNLNTLIQRSNHTQATNGTPYLC

LFLCSPTG.

In another embodiment, the HLA-DPA1 protein has an AA sequence set forth in one of the following GenBank entries: AF013767, AAC64233, AF015295, AAC61669, AF074847, AAD39684, AF074848, AAD39685, AF076284, AAD42927, AF076285, AAD42928, AF092049, AAF00051, AF098794, AAC72845, AF165160, AAD47826, AF346471, AAK27152, AL645931, CAI18040, CAI18041, AL662824, CAI17598, CAI17599, CAI17600, AL805913, CAI18549, AY335522, AAR01827, AY335523, AAR01829, AY335524, AAR01831, AY335525, AAR01833, AY335526, AAR01835, AY335527, AAR01837, AY335528, AAR01839, AY335529, AAR01841, AY335530, AAR01843, AY335531, AAR01845, AY335532, AAR01847, AY335533, AAR01849, AY335534, AAR01851, AY335535, AAR01853, AY335536, AAR01855, AY335537, AAR01857, AY335538, AAR01859, AY335539, AAR01861, AY335540, AAR01863, AY335541, AAR01865, AY335542, AAR01867, AY335543, AAR01869, AY335544, AAR01871, AY375760, AAQ84179, AY375761, AAQ84180, AY375762, AAQ84181, AY375763, AAQ84182, AY375764, AAQ84183, AY375765, AAQ84184, AY375766, AAQ84185, AY375767, AAQ84186, AY375768, AAQ84187, AY375769, AAQ84188, AY375770, AAQ84190, AY375771, AAQ84189, AY375775, AAQ84191, AY375780, AAQ84192, AY375781, AAQ84193, AY375787, AAQ84194, AY375791, AAQ84195, AY375827, AAQ84196, AY375828, AAQ84197, AY375829, AAQ84198, AY375830, AAQ84199, AY375831, AAQ84200, AY375832, AAQ84201, AY375833, AAQ84202, AY375834, AAQ84203, AY375835, AAQ84204, AY375836, AAQ84205, AY375837, AAQ84206, AY375838, AAQ84207, AY375839, AAQ84208, AY375840, AAQ84209, AY618552, AAT92096, AY618553, AAT92097, AY650051, AAT67468, DQ274060, ABB88406, DQ274061, ABB88407, K00514, AAA59786, M23903, M23904, U87556, AAB97110, X02228, CAA26148, X03100, CAA26887, X78199, X82393, X82394, BC009956, AAH09956, CR601798, CR617728, M27487, AAA63220, X00457, and CAA25143. In another embodiment, the HLA-DPA1 protein is encoded by a gene having a nucleotide sequence set forth in one of the above GenBank entries. In another embodiment, the HLA-DPA1 protein has an AA or nucleotide sequence set forth in a GenBank entry for a HLA-DP1A protein. In another embodiment, the HLA-DPA1 protein has an AA or nucleotide sequence set forth in a GenBank entry for a HLADP protein. In another embodiment, the HLA-DPA1 protein has an AA or nucleotide sequence set forth in a GenBank entry for a HLASB protein. In another embodiment, the HLA-DPA1 protein is a homologue of a sequence set forth in one of the above GenBank entries. In another embodiment, the HLA-DPA1 protein is a variant of a sequence set forth in one of the above GenBank entries. In another embodiment, the HLA-DPA1 protein is an isomer of a sequence set forth in one of the above GenBank entries. In another embodiment, the HLA-DPA1 protein is a fragment of a sequence set forth in one of the above GenBank entries. In another embodiment, the HLA-DPA1 protein comprises a sequence set forth in one of the above GenBank entries. Each possibility represents a separate embodiment of the present invention.

The IGF1 protein targeted by methods and compositions of the present invention has, in another embodiment, the sequence:

MGKISSLPTQLFKCCFCDFLKVKMHTMSSSHLFYLALCLLTFTSSATAGP

ETLCGAELVDALQFVCGDRGFYFNKPTGYGSSSRRAPQTGIVDECCFRSC

DLRRLEMYCAPLKPAKSARSVRAQRHTDMPKTQKEVHLKNASRGSAGNKN

YRM (SEQ ID No: 318; GenBank Accession No:

NM_000618).

In another embodiment, the IGF1 protein has an AA sequence set forth in one of the following GenBank entries: X57025 and M11568. In another embodiment, the IGF1 protein is encoded by a gene having a nucleotide sequence set forth in one of the above GenBank entries. In another embodiment, the IGF1 protein is a homologue of a sequence set forth in one of the above GenBank entries. In another embodiment, the IGF1 protein is a variant of a sequence set forth in one of the above GenBank entries. In another embodiment, the IGF1 protein is an isomer of a sequence set forth in one of the above GenBank entries. In another embodiment, the IGF1 protein is a fragment of a sequence set forth in one of the above GenBank entries. In another embodiment, the IGF1 protein comprises a sequence set forth in one of the above GenBank entries. Each possibility represents a separate embodiment of the present invention.

The GPR105 protein targeted by methods and compositions of the present invention has, in another embodiment, the sequence:

MINSTSTQPPDESCSQNLLITQQIIPVLYCMVFIAGILLNGVSGWIFFYV

PSSESFIIYLKNIVIADFVMSLTFPFKILGDSGLGPWQLNVFVCRVSAVL

FYVNMYVSIVFFGLISFDRYYKIVKPLWTSFIQSVSYSKLLSVIVWMLML

LLAVPNIILTNQSVREVTQIKCIELKSELGRKWHKASNYIFVAIFWIVFL

LLIVFYTAITKKIFKSHLKSSRNSTSVKKKSSRNIFSIVFVFFVCFVPYH

IARIPYTKSQTEAHYSCQSKEILRYMKEFTLLLSAANVCLDPIIYFFLCQ

PFREILCKKLHIPLKAQNDLDISRIKRGNTTLESTDTL (SEQ ID

No: 319; GenBank Accession No: BC034989).

In another embodiment, the GPR105 protein has an AA sequence set forth in one of the following GenBank entries: NM_014879 and D13626. In another embodiment, the GPR105 protein is encoded by a gene having a nucleotide sequence set forth in one of the above GenBank entries. In another embodiment, the GPR105 protein is referred to as "purinergic receptor P2Y, G-protein coupled, 14." In another embodiment, the GPR105 protein is a homologue of a sequence set forth in one of the above GenBank entries. In another embodiment, the GPR105 protein is a variant of a sequence set forth in one of the above GenBank entries. In another embodiment, the GPR105 protein is an isomer of a sequence set forth in one of the above GenBank entries. In another embodiment, the GPR105 protein is a fragment of a sequence set forth in one of the above GenBank entries. In another embodiment, the GPR105 protein comprises a sequence set forth in one of the above GenBank entries. Each possibility represents a separate embodiment of the present invention.

The PDGFRL (Platelet-derived growth factor receptor-like) protein targeted by methods and compositions of the present invention has, in another embodiment, the sequence:

MKVWLLLGLLLVHEALEDVTGQHLPKNKRPKEPGENRIKPTNKKVKPKIP

KMKDRDSANSAPKTQSIMMQVLDKGRFQKPAATLSLLAGQTVELRCKGSR

IGWSYPAYLDTFKDSRLSVKQNERYGQLTLVNSTSADTGEFSCWVQLCSG

YICRKDEAKTGSTYIFFTEKGELFVPSPSYFDVVYLNPDRQAVVPCRVTV

LSAKVTLHREFPAKEIPANGTDIVYDMKRGFVYLQPHSEHQGVVYCRAEA

GGRSQISVKYQLLYVAVPSGPPSTTILASSNKVKSGDDISVLCTVLGEPD

VEVEFTWIFPGQKDERPVTIQDTWRLIHRGLGHTTRISQSVITVEDFETI

DAGYYICTAQNLQGQTTVATTVEFS (SEQ ID No: 320;

GenBank Accession No: BC010927).

In another embodiment, the PDGFRL protein has an AA sequence set forth in one of the following GenBank entries: D37965 and NM_006207. In another embodiment, the PDGFRL protein is encoded by a gene having a nucleotide sequence set forth in one of the above GenBank entries. In another embodiment, the PDGFRL protein is a homologue of a sequence set forth in one of the above GenBank entries. In another embodiment, the PDGFRL protein is a variant of a sequence set forth in one of the above GenBank entries. In another embodiment, the PDGFRL protein is an isomer of a sequence set forth in one of the above GenBank entries. In another embodiment, the PDGFRL protein is a fragment of a sequence set forth in one of the above GenBank entries. In another embodiment, the PDGFRL protein comprises a sequence set forth in one of the above GenBank entries. Each possibility represents a separate embodiment of the present invention.

The ADRA2A protein targeted by methods and compositions of the present invention has, in another embodiment, the sequence:

MGSLQPDAGNASWNGTEAPGGGARATPYSLQVTLTLVCLAGLLMLLTVFG

NVLVIIAVFTSRALKAPQNLFLVSLASADILVATLVIPFSLANEVMGYWY

FGKAWCEIYLALDVLFCTSSIVHLCAISLDRYWSITQAIEYNLKRTPRRI

KAIIITVWVISAVISFPPLISIEKKGGGGGPQPAEPRCEINDQKWYVISS

CIGSFFAPCLIMILVYVRIYQIAKRRTRVPPSRRGPDAVAAPPGGTERRP

NGLGPERSAGPGGAEAEPLPTQLNGAPGEPAPAGPRDTDALDLEESSSSD

HAERPPGPRRPERGPRGKGKARASQVKPGDSLPRRGPGATGIGTPAAGPG

EERVGAAKASRWRGRQNREKRFTFVLAVVIGVFVVCWFPFFFTYTLTAVG

CSVPRTLFKFFFWFGYCNSSLNPVIYTIFNHDFRRAFKKILCRGDRKRIV (SEQ ID No: 321; GenBank Accession No: BC050414).

In another embodiment, the ADRA2A protein has an AA sequence set forth in one of the following GenBank entries: AF284095 and NM_000681. In another embodiment, the ADRA2A protein is encoded by a gene having a nucleotide sequence set forth in one of the above GenBank entries. In another embodiment, the ADRA2A protein is a homologue of a sequence set forth in one of the above GenBank entries.

In another embodiment, the ADRA2A protein is a variant of a sequence set forth in one of the above GenBank entries. In another embodiment, the ADRA2A protein is an isomer of a sequence set forth in one of the above GenBank entries. In another embodiment, the ADRA2A protein is a fragment of a sequence set forth in one of the above GenBank entries. In another embodiment, the ADRA2A protein comprises a sequence set forth in one of the above GenBank entries. Each possibility represents a separate embodiment of the present invention.

The CCL19 protein targeted by methods and compositions of the present invention has, in another embodiment, the sequence:

MALLLALSLLVLWTSPAPTLSGTNDAEDCCLSVTQKPIPGYIVRNFHYLL

IKDGCRVPAVVFTTLRGRQLCAPPDQPWVERIIQRLQRTSAKMKRRSS (SEQ ID No: 322; GenBank Accession No: BC027968).

In another embodiment, the CCL19 protein has an AA sequence set forth in one of the following GenBank entries: AB000887 and NM_006274. In another embodiment, the CCL19 protein is encoded by a gene having a nucleotide sequence set forth in one of the above GenBank entries. In another embodiment, the CCL19 protein is a homologue of a sequence set forth in one of the above GenBank entries. In another embodiment, the CCL19 protein is a variant of a sequence set forth in one of the above GenBank entries. In another embodiment, the CCL19 protein is an isomer of a sequence set forth in one of the above GenBank entries. In another embodiment, the CCL19 protein is a fragment of a sequence set forth in one of the above GenBank entries. In another embodiment, the CCL19 protein comprises a sequence set forth in one of the above GenBank entries. Each possibility represents a separate embodiment of the present invention.

The CORIN protein targeted by methods and compositions of the present invention has, in another embodiment, the sequence:

MKQSPALAPEERYRRAGSPKPVLRADDNNMGNGCSQKLATANLLRFLLLV

LIPCICALVLLLVILLSYVGTLQKVYFKSNGSEPLVTDGEIQGSDVILTN

TIYNQSTVVSTAHPDQHVPAWTTDASLPGDQSHRNTSACMNITHSQCQML

PYHATLTPLLSVVRNMEMEKFLKFFTYLHRLSCYQHIMLFGCTLAFPECI

IDGDDSHGLLPCRSFCEAAKEGCESVLGMVNYSWPDFLRCSQFRNQTESS

NVSRICFSPQQENGKQLLCGRGENFLCASGICIPGKLQCNGYNDCDDWSD

EAHCNCSENLFHCHTGKCLNYSLVCDGYDDCGDLSDEQNCDCNPTTEHRC

GDGRCIAMEWVCDGDHDCVDKSDEVNCSCHSQGLVECRNGQCIPSTFQCD

GDEDCKDGSDEENCSVIQTSCQEGDQRCLYNPCLDSCGGSSLCDPNNSLN

NCSQCEPITLELCMNLPYNSTSYPNYFGHRTQKEASISWESSLFPALVQT

NCYKYLMFFSCTILVPKCDVNTGERIPPCRALCEHSKERCESVLGIVGLQ

WPEDTDCSQFPEENSDNQTCLMPDEYVEECSPSHFKCRSGQCVLASRRCD

GQADCDDDSDEENCGCKERDLWECPSNKQCLKHTVICDGFPDCPDYMDEK

NCSFCQDDELECANHACVSRDLWCDGEADCSDSSDEWDCVTLSINVNSSS

FLMVHRAATEHHVCADGWQEILSQLACKQMGLGEPSVTKLIQEQEKEPRW

LTLHSNWESLNGTTLHELLVNGQSCESRSKISLLCTKQDCGRRPAARMNK

RILGGRTSRPGRWPWQCSLQSEPSGHICGCVLIAKKWVLTVAHCFEGREN

AAVWKVVLGINNLDHPSVFMQTRFVKTIILHPRYSRAVVDYDISIVELSE

DISETGYVRPVCLPNPEQWLEPDTYCYITGWGHMGNKMPFKLQEGEVRII

SLEHCQSYFDMKTITTRMICAGYESGTVDSCMGDSGGPLVCEKPGGRWTL

FGLTSWGSVCFSKVLGPGVYSNVSYFVEWIKRQIYIQTFLLN (SEQ ID

No: 323; GenBank Accession No: AF133845).

In another embodiment, the CORIN protein has an AA sequence set forth in one of the following GenBank entries: NM_006587, AF133845, and BC110451. In another embodiment, the CORIN protein is encoded by a gene having a nucleotide sequence set forth in one of the above GenBank entries. In another embodiment, the CORIN protein is a homologue of a sequence set forth in one of the above GenBank entries. In another embodiment, the CORIN protein is a variant of a sequence set forth in one of the above GenBank entries. In another embodiment, the CORIN protein is an isomer of a sequence set forth in one of the above GenBank entries. In another embodiment, the CORIN protein is a fragment of a sequence set forth in one of the above GenBank entries. In another embodiment, the CORIN protein comprises a sequence set forth in one of the above GenBank entries. Each possibility represents a separate embodiment of the present invention.

In another embodiment, the present invention provides a method of stimulating a hair growth in a subject, comprising the step of contacting the subject or the skin or scalp thereof with a compound or composition capable of decreasing a level of a protein encoded by a gene shown in the present invention to be enriched in bald scalp, thereby stimulating a hair growth in a subject. In another embodiment, the gene is depicted in FIG. 3. Each possibility represents a separate embodiment of the present invention.

In another embodiment, the present invention provides a method of stimulating a hair growth in a subject, comprising the step of contacting the subject or the skin or scalp thereof with a compound or composition capable of decreasing an activity of a protein encoded by a gene shown in the present invention to be enriched in bald scalp, thereby stimulating a hair growth in a subject. In another embodiment, the gene is depicted in FIG. 3. Each possibility represents a separate embodiment of the present invention.

In another embodiment, the present invention provides a method of stimulating a hair growth in a scalp in a subject, comprising the step of contacting the subject or the skin or scalp thereof with a compound or composition capable of decreasing an inflammation in the scalp, thereby stimulating a hair growth in a scalp in a subject. As provided herein, results of the present invention demonstrate that proteins that mediate inflammation are enriched in bald scalp.

In another embodiment, the present invention provides a method of testing a subject for a presence of an AGA, comprising the steps of: (a) measuring a level of a prostaglandin D2 (PGD2) in the scalp of the subject; and (b) comparing the level to a reference standard, wherein, if the level is appreciably elevated relative to the reference standard, then the subject has AGA.

In another embodiment, the present invention provides a method of testing a subject for a presence of an AGA, comprising the steps of: (a) measuring a level of a PGD2 metabolite in the scalp of the subject; and (b) comparing the level to a reference standard, wherein, if the level is appreciably elevated relative to the reference standard, then the subject has AGA.

In another embodiment, the present invention provides a method of testing a subject for a presence of an AGA, comprising the steps of: (a) measuring a level of a PGD2 in a body fluid of the subject; and (b) comparing the level to a reference standard, wherein, if the level is appreciably elevated relative to the reference standard, then the subject has AGA.

In another embodiment, the present invention provides a method of testing a subject for a presence of an AGA, comprising the steps of: (a) measuring a level of a PGD2 metabolite in a body fluid of the subject; and (b) comparing the level to a reference standard, wherein, if the level is appreciably elevated relative to the reference standard, then the subject has AGA.

In another embodiment, the present invention provides a method of testing an efficacy of baldness therapy in a subject, comprising the steps of: (a) measuring a first level of a PGD2 in the scalp of the subject, and (b) administering the baldness therapy to the subject; and (c) measuring a second level of the PGD2 in the scalp, wherein, if the second level is significantly decreased relative to the first level, then the baldness therapy is efficacious.

In another embodiment, the present invention provides a method of testing an efficacy of baldness therapy in a subject, comprising the steps of: (a) measuring a first level of a PGD2 metabolite in the scalp of the subject, and (b) administering the baldness therapy to the subject; and (c) measuring a second level of the PGD2 in the scalp, wherein, if the second level is significantly decreased relative to the first level, then the baldness therapy is efficacious.

In another embodiment, the present invention provides a method of testing an efficacy of baldness therapy in a subject, comprising the steps of: (a) measuring a first level of a PGD2 in a body fluid of the subject, and (b) administering the baldness therapy to the subject; and (c) measuring a second level of the PGD2 in the body fluid, wherein, if the second level is significantly decreased relative to the first level, then the baldness therapy is efficacious.

In another embodiment, the present invention provides a method of testing an efficacy of baldness therapy in a subject, comprising the steps of: (a) measuring a first level of a PGD2 metabolite in a body fluid of the subject, and (b) administering the baldness therapy to the subject; and (c) measuring a second level of the PGD2 in the body fluid, wherein, if the second level is significantly decreased relative to the first level, then the baldness therapy is efficacious.

In another embodiment, the present invention provides a method of testing a subject for a presence of acne, comprising the steps of: (a) measuring a level of a PGD2 in the scalp of the subject; and (b) comparing the level to a reference standard, wherein, if the level is appreciably elevated relative to the reference standard, then the subject has acne.

In another embodiment, the present invention provides a method of testing a subject for a presence of acne, comprising the steps of: (a) measuring a level of a PGD2 metabolite in the scalp of the subject; and (b) comparing the level to a reference standard, wherein, if the level is appreciably elevated relative to the reference standard, then the subject has acne.

In another embodiment, the present invention provides a method of testing a subject for a presence of acne, comprising the steps of: (a) measuring a level of a PGD2 in a body fluid of the subject; and (b) comparing the level to a reference standard, wherein, if the level is appreciably elevated relative to the reference standard, then the subject has acne.

In another embodiment, the present invention provides a method of testing a subject for a presence of acne, comprising the steps of: (a) measuring a level of a PGD2 metabolite in a body fluid of the subject; and (b) comparing the level to a reference standard, wherein, if the level is appreciably elevated relative to the reference standard, then the subject has acne.

In another embodiment, the present invention provides a method of testing a subject for a presence of rosacea, comprising the steps of: (a) measuring a level of a PGD2 in the scalp of the subject; and (b) comparing the level to a reference standard, wherein, if the level is appreciably elevated relative to the reference standard, then the subject has rosacea.

In another embodiment, the present invention provides a method of testing a subject for a presence of rosacea, comprising the steps of: (a) measuring a level of a PGD2 metabolite in the scalp of the subject; and (b) comparing the level to a reference standard, wherein, if the level is appreciably elevated relative to the reference standard, then the subject has rosacea.

In another embodiment, the present invention provides a method of testing a subject for a presence of rosacea, comprising the steps of: (a) measuring a level of a PGD2 in a body fluid of the subject; and (b) comparing the level to a reference standard, wherein, if the level is appreciably elevated relative to the reference standard, then the subject has rosacea.

In another embodiment, the present invention provides a method of testing a subject for a presence of rosacea, comprising the steps of: (a) measuring a level of a PGD2 metabolite in a body fluid of the subject; and (b) comparing the level to a reference standard, wherein, if the level is appreciably elevated relative to the reference standard, then the subject has rosacea.

In another embodiment, the present invention provides a method of testing an efficacy of therapy for acne or rosacea in a subject, comprising the steps of: (a) measuring a first level of a PGD2 in the scalp of the subject, and (b) administering the therapy for acne or rosacea to the subject; and (c) measuring a second level of the PGD2 in the scalp, wherein, if the second level is significantly decreased relative to the first level, then the therapy for acne or rosacea is efficacious.

In another embodiment, the present invention provides a method of testing an efficacy of therapy for acne or rosacea in a subject, comprising the steps of: (a) measuring a first level of a PGD2 metabolite in the scalp of the subject, and (b) administering the therapy for acne or rosacea to the subject; and (c) measuring a second level of the PGD2 in the scalp, wherein, if the second level is significantly decreased relative to the first level, then the therapy for acne or rosacea is efficacious.

In another embodiment, the present invention provides a method of testing an efficacy of therapy for acne or rosacea in a subject, comprising the steps of: (a) measuring a first level of a PGD2 in a body fluid of the subject, and (b) administering the therapy for acne or rosacea to the subject; and (c) measuring a second level of the PGD2 in the body fluid, wherein, if the second level is significantly decreased relative to the first level, then the therapy for acne or rosacea is efficacious.

In another embodiment, the present invention provides a method of testing an efficacy of therapy for acne or rosacea in a subject, comprising the steps of: (a) measuring a first level of a PGD2 metabolite in a body fluid of the subject, and (b) administering the therapy for acne or rosacea to the subject; and (c) measuring a second level of the PGD2 in the body fluid, wherein, if the second level is significantly decreased relative to the first level, then the therapy for acne or rosacea is efficacious.

"Appreciably" and "significantly" refer, in another embodiment, to a change of at least 1 standard deviation (std). In another embodiment, the terms refer to a change of at least 1.5 std. In another embodiment, the terms refer to a change of at least 2 std. In another embodiment, the terms refer to a change of at least 3 std. In another embodiment, the terms refer to a change of at least 4 std. In another embodiment, the terms refer to a change of more than 1.5 std. In another embodiment, the terms refer to a change of more than 2 std. In another embodiment, the terms refer to a change of more than 3 std. In another embodiment, the terms refer to a change of more than 4 std.

In another embodiment, the terms refer to a change of at least 50%. In another embodiment, the terms refer to a change of at least 70%. In another embodiment, the terms refer to a change of at least 2 fold (e.g. a doubling or a reduction by 50%). In another embodiment, the terms refer to a change of at least 3 fold. In another embodiment, the terms refer to a change of at least 4 fold. In another embodiment, the terms refer to a change of at least 5 fold. In another embodiment, the terms refer to a change of more than 50%. In another embodiment, the terms refer to a change of more than 70%. In another embodiment, the terms refer to a change of more than 2 fold. In another embodiment, the terms refer to a change of more than 3 fold. In another embodiment, the terms refer to a change of more than 4 fold. In another embodiment, the terms refer to a change of more than 5 fold.

In another embodiment, the terms refer to a change considered statistically significant, relative to the reference standard, using an assay known in the art. Each possibility represents a separate embodiment of the present invention.

In another embodiment, the present invention provides a method of inhibiting or reversing hair loss, comprising the step of contacting a subject with a compound or composition that increases an activity or level of a protein encoded by an organogenesis gene, thereby inhibiting or reversing hair loss.

In another embodiment, the present invention provides a method of inhibiting or reversing hair loss, comprising the step of contacting a subject with a compound or composition that increases an activity or level of a protein encoded by a UV-responsive gene, thereby inhibiting or reversing hair loss. In another embodiment, the gene is selected from COL11A1, COL3A1, PCNA, CDK4, and CYCLIN G. Each possibility represents a separate embodiment of the present invention.

In another embodiment, the present invention provides a method of inhibiting or reversing hair loss, comprising the step of contacting a subject with a compound or composition that decreases an activity or expression of an androgen pathway gene, thereby inhibiting or reversing hair loss. In another embodiment, the gene is selected from AR, 3beta-HSD, 17beta-HSD, 5-alpha reductase 1, and 5-alpha reductase 2. Each possibility represents a separate embodiment of the present invention.

In another embodiment, the present invention provides a method of inhibiting or reversing hair loss, comprising the step of contacting a subject with a compound or composition that decreases an activity or expression of a Major Histocompatibility Complex (MHC) gene, thereby inhibiting or reversing hair loss. In another embodiment, the gene is selected from HLA-C and HLA-DPA1. Each possibility represents a separate embodiment of the present invention.

In another embodiment, the present invention provides a method of inhibiting or reversing hair loss, comprising the step of contacting a subject with a compound or composition that increases an activity or expression leucine rich repeat-containing protein, thereby inhibiting or reversing hair loss. In another embodiment, the gene is selected from LRRC15 and GPR49. In another embodiment, the compound is a G protein small molecule activator of GPR49. In another embodiment, the compound is a G protein small molecule activator of a leucine-rich repeat-containing GPCR. Each possibility represents a separate embodiment of the present invention.

In another embodiment, the present invention provides a method of inhibiting or reversing hair loss, comprising the step of contacting a subject with a compound or composition that increases an activity or expression of an immune-related gene, thereby inhibiting or reversing hair loss, thereby inhibiting or reversing hair loss.

In another embodiment, the present invention provides a method of inhibiting or reversing hair loss, comprising the step of contacting a subject with a compound or composition that increases an activity or expression of an anti-protease, thereby inhibiting or reversing hair loss, thereby inhibiting or reversing hair loss. In another embodiment, the anti-protease is related to Serpin A. Each possibility represents a separate embodiment of the present invention.

In another embodiment, the present invention provides a method of inhibiting or reversing hair loss, comprising the step of contacting a subject with a compound or composition that increases an activity or expression of an anti-vascular factor, thereby inhibiting or reversing hair loss, thereby inhibiting or reversing hair loss. In another embodiment, the anti-vascular factor is related to CDT6. In another embodiment, the anti-vascular factor suppresses angiogenesis in the high-metabolism milieu of HF. Each possibility represents a separate embodiment of the present invention.

In another embodiment, the present invention provides a method of inhibiting or reversing hair loss, comprising the step of contacting a subject with a compound or composition that decreases an activity or expression of a pro-inflammatory gene, thereby inhibiting or reversing hair loss.

In another embodiment, the present invention provides a method of inhibiting or reversing hair loss, comprising the step of contacting a subject with a compound or composition that increases an activity or expression of an anti-inflammatory gene, thereby inhibiting or reversing hair loss.

In another embodiment, the present invention provides a method of inhibiting or reversing hair growth, comprising the step of stimulating a PGD2-related pathway of the present invention.

In another embodiment, the utility of methods and compositions of the present invention is not limited to AGA; rather, the methods and compositions are efficacious in any type of alopecia. The present invention has identified pathways using the normal biology of hair cycling as opposed to a pathophysiological model.

In another embodiment, the present invention provides a method of inhibiting or reversing hair loss, comprising the step of contacting a subject with a compound or composition capable of inhibiting an activity of PGD2S. In another embodiment, the activity is a lipophilic ligand-binding activity. In another embodiment, the activity is a carrier activity for retinaldehyde. In another embodiment, the activity is a carrier activity for RA. In another embodiment, the activity is a carrier activity for biliverdin. In another embodiment, the activity is a carrier activity for bilirubin. In another embodiment, the activity is a carrier activity for any other PGD2S ligand known in the art. In another embodiment, the activity is any other PGD2S activity known in the art. Each possibility represents a separate embodiment of the present invention.

In another embodiment, a composition or method of the present invention is utilized on human skin. In another embodiment, the composition or method is utilized on an area of unwanted hair growth. In another embodiment, the area is the face. In another embodiment, the area is the bikini area. In another embodiment, the area is the legs. In another embodiment, the area is the arms. In another embodiment, the area is the chest. In another embodiment, the area is the armpits. In another embodiment, the area is any other area with undesired hair growth. Each possibility represents a separate embodiment of the present invention.

In another embodiment, the present invention provides a method of stimulating a hair growth in a subject, the method comprising the steps of (a) isolating an alpha-6 integrin$^{high}$ CD200$^{high}$ cell population from a haired area of the subject; and (b) contacting a bald or hair-deficient region of the subject with the alpha-6 integrin$^{high}$ CD200$^{high}$ cell population, thereby stimulating a hair growth in a subject.

In another embodiment, the present invention provides a method of stimulating a hair growth in a subject, the method comprising the steps of (a) isolating an alpha-6 integrin$^{high}$ CD200$^{high}$ cell population from a haired area of the subject; and (b) transplanting the alpha-6 integrin$^{high}$ CD200$^{high}$ cell population into a bald or hair-deficient region of the subject, thereby stimulating a hair growth in a subject.

As provided herein, an alpha-6 integrin$^{high}$ CD200$^{high}$ stem cell population is present in haired, but not bald scalp. Thus, this cell population is capable of generating new HF. In another embodiment, methods and compositions of the present invention utilize an integrin$^{high}$ CD200$^+$ stem cell population. In another embodiment, an integrin$^+$ CD200$^{high}$ stem cell population is used. In another embodiment, an integrin$^+$ CD200$^+$ stem cell population is used. Each possibility represents a separate embodiment of the present invention.

"Hair-deficient" refers, in another embodiment, to a region of the skin or scalp that is lacking an normal amount of hair. In another embodiment, the term refers to a region wherein the subject is dissatisfied with the amount of hair present. Each possibility represents a separate embodiment of the present invention.

"Alpha-6 integrin$^{high}$ CD200$^{high}$ cell population" refers, in another embodiment, to a cell population that exhibits an elevated alpha-6 integrin level, relative to other cells in the HF. In another embodiment, the population exhibits an elevated alpha-6 integrin level, relative to other cells in the epidermis. In another embodiment, the population exhibits is distinguishable by FACS from non-alpha-6 integrin$^-$ cells by FACS. In another embodiment, the population exhibits is distinguishable by FACS from non-alpha-6 integrin$^{low}$ cells by FACS.

In another embodiment, the term refers to a cell population that exhibits an elevated CD200 level, relative to other cells in the HF. In another embodiment, the population exhibits an elevated CD200 level, relative to other cells in the epidermis. In another embodiment, the population exhibits is distinguishable by FACS from CD200$^{low}$ cells by FACS. In another embodiment, the population exhibits is distinguishable by FACS from CD200$^-$ cells by FACS.

Each definition of "alpha-6 integrin$^{high}$ CD200$^{high}$ cell" represents a separate embodiment of the present invention.

Methods are well known in the art for isolation of a cell population bearing 1 or more particular marker proteins. In another embodiment, fluorescence-activated cell sorting (FACS) is utilized (Examples herein). In another embodiment, antibody-coated magnetic beads are utilized. In another embodiment, any other method known in the art is utilized. Each possibility represents a separate embodiment of the present invention.

Methods of injecting, transporting, and administering cells into the skin or scalp of a subject are well known in the art, and are described, for example, in Zheng Y et al (Organogenesis from dissociated cells: generation of mature cycling hair follicles from skin-derived cells. J Invest Dermatol. 2005 May; 124(5):867-76) and in Example 9 herein. Each possibility represents a separate embodiment of the present invention.

In another embodiment, a method of present invention further comprises the step of culturing ex vivo an alpha-6 integrin$^{high}$ CD200$^{high}$ cell population. In another embodiment, the cell population is expanded ex vivo. Each possibility represents a separate embodiment of the present invention.

In another embodiment, the present invention provides a method of stimulating a hair growth in a subject, comprising the step of contacting the subject or the skin or scalp thereof with a compound or composition capable of increasing a level of a CD200 protein, thereby stimulating a hair growth in a subject. In another embodiment, increasing CD200 protein levels reduces inflammation in the scalp. Each possibility represents a separate embodiment of the present invention.

In another embodiment, the present invention provides a method of stimulating a hair growth in a subject, comprising the step of contacting the subject or the skin or scalp thereof with a recombinant CD200 protein, thereby stimulating a hair growth in a subject. In another embodiment, a mimetic of the CD200 protein is administered. In another embodiment, an analogue of the CD200 protein is administered. Each possibility represents a separate embodiment of the present invention. In another embodiment, administration of a recombinant CD200 protein or a mimetic or analogue thereof reduces inflammation in the scalp. Each possibility represents a separate embodiment of the present invention.

In another embodiment, the present invention provides a method of stimulating a hair growth in a subject, comprising the step of contacting the subject or the skin or scalp thereof with a compound or composition capable of increasing an activity of a CD200 protein, thereby stimulating a hair growth in a subject. In another embodiment, increasing CD200 protein activity reduces inflammation in the scalp. Each possibility represents a separate embodiment of the present invention.

As provided herein, an alpha-6 integrin$^{high}$ CD200$^{high}$ stem cell population is present in haired, but not bald scalp. Thus, CD200 and methods of upregulating same are efficacious in stimulation of hair growth.

The sequence of the alpha-6 integrin (ITGA6) of methods and compositions of the present invention is, in another embodiment:

MAAAGQLCLLYLSAGLLSRLGAAFNLDTREDNVIRKYGDPGSLFGFSLAM

HWQLQPEDKRLLLVGAPRAEALPLQRANRTGGLYSCDITARGPCTRIEFD

-continued

NDADPTSESKEDQWMGVTVQSQGPGGKVVTCAHRYEKRQHVNTKQESRDI

FGRCYVLSQNLRIEDDMDGGDWSFCDGRLRGHEKFGSCQQGVAATFTKDF

HYIVFGAPGTYNWKGIVRVEQKNNTFFDMNIFEDGPYEVGGETEHDESLV

PVPANSYLGFSLDSGKGIVSKDEITFVSGAPRANHSGAVVLLKRDMKSAH

LLPEHIFDGEGLASSFGYDVAVVDLNKDGWQDIVIGAPQYFDRDGEVGGA

VYVYMNQQGRWNNVKPIRLNGTKDSMFGIAVKNIGDINQDGYPDIAVGAP

YDDLGKVFIYHGSANGINTKPTQVLKGISPYFGYSIAGNMDLDRNSYPDV

AVGSLSDSVTIFRSRPVINIQKTITVTPNRIDLRQKTACGAPSGICLQVK

SCFEYTANPAGYNPSISIVGTLEAEKERRKSGLSSRVQFRNQGSEPKYTQ

ELTLKRQKQKVCMEETLWLQDNIRDKLRPIPITASVEIQEPSSRRRVNSL

PEVLPILNSDEPKTAHIDVHFLKEGCGDDNVCNSNLKLEYKFCTREGNQD

KFSYLPIQKGVPELVLKDQKDIALEITVTNSPSNPRNPTKDGDDAHEAKL

IATFPDTLTYSAYRELRAFPEKQLSCVANQNGSQADCELGNPFKRNSNVT

FYLVLSTTEVTFDTPDLDINLKLETTSNQDNLAPITAKAKVVIELLLSVS

GVAKPSQVYFGGTVVGEQAMKSEDEVGSLIEYEFRVINLGKPLTNLGTAT

LNIQWPKEISNGKWLLYLVKVESKGLEKVTCEPQKEINSLNLTESHNSRK

KREITEKQIDDNRKFSLFAERKYQTLNCSVNVNCVNIRCPLRGLDSKASL

ILRSRLWNSTFLEEYSKLNYLDILMRAFIDVTAAAENIRLPNAGTQVRVT

VFPSKTVAQYSGVPWWIILVAILAGILMLALLVFILWKCGFFKRSRYDDS

VPRYHAVRIRKEEREIKDEKYIDNLEKKQWITKWNENESYS (SEQ ID

No: 274; GenBank Accession No: NM_001079818).

In another embodiment, the ITGA6 is a homologue of SEQ ID No: 276. In another embodiment, the ITGA6 is a variant of SEQ ID No: 276. In another embodiment, the ITGA6 is an isomer of SEQ ID No: 276. In another embodiment, the ITGA6 is a fragment of SEQ ID No: 276. In another embodiment, the ITGA6 comprises SEQ ID No: 276. Each possibility represents a separate embodiment of the present invention.

In another embodiment, the ITGA6 has an AA sequence set forth in one of the following GenBank entries: NM_000210, BC050585, AH008066, AF166343, and L40385. In another embodiment, the ITGA6 has a nucleotide sequence set forth in one of the above GenBank entries. In another embodiment, the ITGA6 is a homologue of a sequence set forth in one of the above GenBank entries. In another embodiment, the ITGA6 is a variant of a sequence set forth in one of the above GenBank entries. In another embodiment, the ITGA6 is an isomer of a sequence set forth in one of the above GenBank entries. In another embodiment, the ITGA6 is a fragment of a sequence set forth in one of the above GenBank entries. In another embodiment, the ITGA6 comprises a sequence set forth in one of the above GenBank entries. Each possibility represents a separate embodiment of the present invention.

The sequence of the CD200 of methods and compositions of the present invention is, in another embodiment:

MERLVIRMPFSHLSTYSLVWVMAAVVLCTAQVQVVTQDEREQLYTPASLK

CSLQNAQEALIVTWQKKKAVSPENMVTFSENHGVVIQPAYKDKINITQLG

LQNSTITFWNITLEDEGCYMCLFNTFGFGKISGTACLTVYVQPIVSLHYK

FSEDHLNITCSATARPAPMVFWKVPRSGIENSTVTLSHPNGTTSVTSILH

IKDPKNQVGKEVICQVLHLGTVTDFKQTVNKGYWFSVPLLLSIVSLVILL

VLISILLYWKRHRNQDREP (SEQ ID No: 275; GenBank

Accession No: NM_005944).

In another embodiment, the CD200 is a homologue of SEQ ID No: 275. In another embodiment, the CD200 is a variant of SEQ ID No: 275. In another embodiment, the CD200 is an isomer of SEQ ID No: 275. In another embodiment, the CD200 is a fragment of SEQ ID No: 275. In another embodiment, the CD200 comprises SEQ ID No: 275. Each possibility represents a separate embodiment of the present invention.

In another embodiment, the sequence of the CD200 is:

MERLVIRMPFCHLSTYSLVWVMAAVVLCTAQVQVVTQDEREQLYTPASLK

CSLQNAQEALIVTWQKKKAVSPENMVTFSENHGVVIQPAYKDKINITQLG

LQNSTITFWNITLEDEGCYMCLFNTFGFGKISGTACLTVYVQPIVSLHYK

FSEDHLNITCSATARPAPMVFWKVPRSGIENSTVTLSHPNGTTSVTSILH

IKDPKNQVGKEVICQVLHLGTVTDFKQTVNKGYWFSVPLLLSIVSLVILL

VLISILLYWKRHRNQDREP (SEQ ID No: 276; GenBank

Accession No: BC031103).

In another embodiment, the CD200 is a homologue of SEQ ID No: 276. In another embodiment, the CD200 is a variant of SEQ ID No: 276. In another embodiment, the CD200 is an isomer of SEQ ID No: 276. In another embodiment, the CD200 is a fragment of SEQ ID No: 276. In another embodiment, the CD200 comprises SEQ ID No: 276. Each possibility represents a separate embodiment of the present invention.

In another embodiment, the CD200 has an AA sequence set forth in one of the following GenBank entries NM_001004196, BC022522, AY603771, and AF495380. In another embodiment, the CD200 has a nucleotide sequence set forth in one of the above GenBank entries. In another embodiment, the CD200 is a homologue of a sequence set forth in one of the above GenBank entries. In another embodiment, the CD200 is a variant of a sequence set forth in one of the above GenBank entries. In another embodiment, the CD200 is an isomer of a sequence set forth in one of the above GenBank entries. In another embodiment, the CD200 is a fragment of a sequence set forth in one of the above GenBank entries. In another embodiment, the CD200 comprises a sequence set forth in one of the above GenBank entries. Each possibility represents a separate embodiment of the present invention.

In another embodiment, a method of the present invention utilizes a biologically active fragment of a protein product of a target gene of the present invention. In another embodiment, the protein product is CD200. CD200 biologically active fragments, analogues, and mimetics are well known in the art, and are described, for example, in patent applications US20040054145, WO 03/077947, WO 02/42332, US20040213783, and US20050084490. In another embodiment, the CD200 analogue is a soluble version of CD200. In another embodiment, the CD200 analogue is a CD200 fusion protein. In another embodiment, the CD200 analogue is a CD200Fc fusion protein. In another embodiment, a CD200R agonist is utilized in a method of the present invention. In another embodiment, the CD200R agonist is a monoclonal antibody. In another embodiment, the CD200 biologically active fragment, analogue, or mimetic or CD200R agonist is used in other applications (e.g. for immunosuppression for transplants). Each possibility represents a separate embodiment of the present invention.

In another embodiment, a mimetic compound of the present invention is derived from a target protein of the present invention by incorporating 1 or more modified AA residues. In another embodiment, one or more of the termini is derivatized to include a blocking group, i.e. a chemical substituent suitable to protect and/or stabilize the N- and C-termini from undesirable degradation. In another embodiment, "undesirable degradation" refers to any type of enzymatic, chemical or biochemical breakdown of the compound at its termini which is likely to affect the function of the compound, i.e. sequential degradation of the compound at a terminal end thereof.

In another embodiment, blocking groups include protecting groups conventionally used in the art of peptide chemistry which will not adversely affect the in vivo activities of the peptide. For example, suitable N-terminal blocking groups can be introduced by alkylation or acylation of the N-terminus. Examples of suitable N-terminal blocking groups include $C_1$-$C_5$ branched or unbranched alkyl groups, acyl groups such as formyl and acetyl groups, as well as substituted forms thereof, such as the acetamidomethyl (Acm) group. Desamino AA analogs are also useful N-terminal blocking groups, and can either be coupled to the N-terminus of the peptide or used in place of the N-terminal reside. Suitable C-terminal blocking groups, in which the carboxyl group of the C-terminus is either incorporated or not, include esters, ketones or amides. Ester or ketone-forming alkyl groups, particularly lower alkyl groups such as methyl, ethyl and propyl, and amide-forming amino groups such as primary amines (—$NH_2$), and mono- and di-alkyl amino groups such as methyl amino, ethylamino, dimethylamino, diethylamino, methylethylamino and the like are examples of C-terminal blocking groups. Descarboxylated AA analogues such as agmatine are also useful C-terminal blocking groups and can be either coupled to the peptide's C-terminal residue or used in place of it. In another embodiment, the free amino and carboxyl groups at the termini are removed altogether from the peptide to yield desamino and descarboxylated forms thereof without affect on peptide activity.

In another embodiment, a mimetic compound of the present invention is derived from a target protein of the present invention by another modification. In another embodiment, such modifications include, but are not limited to, substitution of one or more of the AA in the natural L-isomeric form with D-isomeric AA. In another embodiment, the peptide includes one or more D-amino acid resides, or comprises AA that are all in the D-form. Retro-inverso forms of peptides in accordance with the present invention are also contemplated, for example, inverted peptides in which all amino acids are substituted with D-amino acid forms.

In another embodiment, mimetic compounds of the present invention are acid addition salts of a target protein of the present invention. In another embodiment, a peptide derived from a target protein of the present invention is treated with an inorganic acid such as hydrochloric, hydrobromic, sulfuric, nitric, phosphoric, and the like, or an organic acid such as an acetic, propionic, glycolic, pyruvic, oxalic, malic, malonic, succinic, maleic, fumaric, tataric, citric, benzoic, cinnamie, mandelic, methanesulfonic, ethanesulfonic, p-toluenesulfonic, salicyclic and the like, to provide a water soluble salt of the peptide suitable for use in the invention.

In another embodiment, a mimetic compound of the present invention is produced by a process comprising the step of in vivo or in vitro chemical derivatization of a peptide derived from a target protein of the present invention, e.g., acetylation, or carboxylation. Also included are modifications of glycosylation, e.g., those made by modifying the glycosylation patterns of a polypeptide during its synthesis and processing or in further processing steps; e.g., by exposing the polypeptide to enzymes which affect glycosylation, e.g., mammalian glycosylating or deglycosylating enzymes. In another embodiment, a mimetic compound of the present invention comprises a phosphorylated AA residue, e.g., phosphotyrosine, phosphoserine, or phosphothreonine.

In another embodiment, a mimetic compound of the present invention is produced by modifying a peptide derived from a target protein of the present invention using ordinary molecular biological techniques so as to improve it resistance to proteolytic degradation or to optimize solubility properties. In another embodiment, an peptide is modified to render it more suitable as a therapeutic agent. Analogs of such polypeptides include those containing residues other than naturally occurring L-amino acids, e.g., D-amino acids or non-naturally occurring synthetic amino acids. The peptides of the invention are not limited to products of any of the specific exemplary processes listed herein.

Methods of identifying mimetic compounds are well known in the art, and are described, for example, in Song J et al, Biochem Cell Biol 76(2-3): 177-188, 1998; Vogt A et al, J Biol Chem. 270(2): 660-4, 1995; Alexopoulos K et al, J Med Chem 47(13): 3338-52, 2004; Andronati S A et al, Curr Med Chem 11(9): 1183-211, 2004; Breslin M J et al, Bioorg Med Chem Lett 13(10): 1809-12, 2003; and WO 02/081649 ("ErbB interface peptidomimetics and methods of use thereof") in the name of Greene et al. In another embodiment, model building is used to design the mimetic compounds as described in one of the above references. In another embodiment, solubility of the mimetic compounds is optimized as described in one of the above references. Each possibility represents a separate embodiment of the present invention.

Each modification, type of modification, and combination thereof represents a separate embodiment of the present invention.

In another embodiment, the present invention provides a method of treating AGA, comprising performing a method of the present invention.

In another embodiment, the present invention provides a method of reversing AGA, comprising performing a method of the present invention.

In another embodiment, the present invention provides a method of generating new HF, comprising performing a method of the present invention.

In another embodiment, the present invention provides a method of stimulating formation of new HF, comprising performing a method of the present invention.

In another embodiment, the present invention provides a method of predicting the development of AGA in a subject, comprising the step of measuring an amount of PGD2 in the skin or scalp of the subject. In another embodiment, an amount of a PGD2 metabolite is measured. Each possibility represents a separate embodiment of the present invention.

In another embodiment, a method of the present invention further comprises the step of contacting the subject with a pro-hair growth prostaglandin. In another embodiment, the scalp of the subject is contacted with the pro-hair growth prostaglandin. In another embodiment, the skin of the subject is contacted with the pro-hair growth prostaglandin. In another embodiment, the subject is contacted with the pro-hair growth prostaglandin, e.g. systemically, and the pro-hair growth prostaglandin reaches the target tissue via diffusion, active transport, or another biological process. Each possibility represents a separate embodiment of the present invention.

In another embodiment, the pro-hair growth prostaglandin is a prostaglandin E1. In another embodiment, the pro-hair growth prostaglandin is a prostaglandin E1 analogue. In another embodiment, the prostaglandin E1 analogue is Misoprostol (cytotec). In another embodiment, the prostaglandin E1 analogue is 11β-Misoprostol. In another embodiment, the prostaglandin E1 analogue is 8-iso Misoprostol. In another embodiment, the prostaglandin E1 analogue is Mifepristone. In another embodiment, the prostaglandin E1 analogue is Misoprostol (free acid). In another embodiment, the prostaglandin E1 analogue is Prostaglandin E1. In another embodiment, the prostaglandin E1 analogue is 11β-Prostaglandin E1. In another embodiment, the prostaglandin E1 analogue is 13,14-dihydro-15-keto Prostaglandin E1. In another embodiment, the prostaglandin E1 analogue is 13,14-dihydro-15-keto Prostaglandin E1-d4. In another embodiment, the prostaglandin E1 analogue is 13,14-dihydro-19(R)-hydroxy Prostaglandin E1. In another embodiment, the prostaglandin E1 analogue is 15-keto Prostaglandin E1. In another embodiment, the prostaglandin E1 analogue is 16,16-dimethyl-6-keto Prostaglandin E1. In another embodiment, the prostaglandin E1 analogue is 16-phenyl tetranor Prostaglandin E1. In another embodiment, the prostaglandin E1 analogue is 19(R)-hydroxy Prostaglandin E1. In another embodiment, the prostaglandin E1 analogue is 2,3-dinor Prostaglandin E1. In another embodiment, the prostaglandin E1 analogue is 8-iso Prostaglandin E1. In another embodiment, the prostaglandin E1 analogue is Bicyclo Prostaglandin E1. In another embodiment, the prostaglandin E1 analogue is Dihomo-γ-Linolenic Acid. In another embodiment, the prostaglandin E1 analogue is Limaprost. In another embodiment, the prostaglandin E1 analogue is Δ17-Prostaglandin E1. In another embodiment, the pro-hair growth prostaglandin is selected from 11β-Misoprostol, 8-iso Misoprostol, Mifepristone, Misoprostol (free acid), Prostaglandin E1, 11β-Prostaglandin E1, 13,14-dihydro-15-keto Prostaglandin E1, 13,14-dihydro-15-keto Prostaglandin E1-d4, 13,14-dihydro-19(R)-hydroxy Prostaglandin E1, 15-keto Prostaglandin E1, 16,16-dimethyl-6-keto Prostaglandin E1, 16-phenyl tetranor Prostaglandin E1, 19(R)-hydroxy Prostaglandin E1, 2,3-dinor Prostaglandin E1, 8-iso Prostaglandin E1, Bicyclo Prostaglandin E1, Dihomo-γ-Linolenic Acid, Limaprost, and Δ17-Prostaglandin E1. In another embodiment, the prostaglandin E1 analogue is selected from 11β-Misoprostol, 8-iso Misoprostol, Mifepristone, Misoprostol (free acid), Prostaglandin E1, 11β-Prostaglandin E1, 13,14-dihydro-15-keto Prostaglandin E1, 13,14-dihydro-15-keto Prostaglandin E1-d4, 13,14-dihydro-19(R)-hydroxy Prostaglandin E1, 15-keto Prostaglandin E1, 16,16-dimethyl-6-keto Prostaglandin E1, 16-phenyl tetranor Prostaglandin E1, 19(R)-hydroxy Prostaglandin E1, 2,3-dinor Prostaglandin E1, 8-iso Prostaglandin E1, Bicyclo Prostaglandin E1, Dihomo-γ-Linolenic Acid, Limaprost, and Δ17-Prostaglandin E1. In another embodiment, the pro-hair growth prostaglandin is any other prostaglandin E1 analogue known in the art. In another embodiment, the pro-hair growth prostaglandin is any other agonistic prostaglandin E1 analogue known in the art. In another embodiment, the pro-hair growth prostaglandin is any other prostaglandin E1 analogue known in the art that mimics the action of prostaglandin E1. In another embodiment, a compound or composition that increases prostaglandin E1 levels or prostaglandin E1 synthesis is administered to the subject. Each possibility represents a separate embodiment of the present invention.

In another embodiment, the pro-hair growth prostaglandin is a prostaglandin E2. In another embodiment, the pro-hair growth prostaglandin is a prostaglandin E2 analogue. In another embodiment, the pro-hair growth prostaglandin is 11-deoxy-16,16-dimethyl Prostaglandin E2. In another embodiment, the pro-hair growth prostaglandin is 11-deoxy Prostaglandin E2. In another embodiment, the pro-hair growth prostaglandin is 11β-Prostaglandin E2. In another embodiment, the pro-hair growth prostaglandin is 13,14-dihydro-15-keto Prostaglandin E1-d4. In another embodiment, the pro-hair growth prostaglandin is 13,14-dihydro Prostaglandin E1-d4. In another embodiment, the pro-hair growth prostaglandin is 15(R)-15-methyl Prostaglandin E2. In another embodiment, the pro-hair growth prostaglandin is 15(R)-Prostaglandin E2. In another embodiment, the pro-hair growth prostaglandin is 15(S)-15-methyl Prostaglandin E2. In another embodiment, the pro-hair growth prostaglandin is 16-phenoxy tetranor Prostaglandin E2. In another embodiment, the pro-hair growth prostaglandin is 16-phenyl tetranor Prostaglandin E2. In another embodiment, the pro-hair growth prostaglandin is 20-ethyl Prostaglandin E2. In another embodiment, the pro-hair growth prostaglandin is 5-trans Prostaglandin E2. In another embodiment, the pro-hair growth prostaglandin is 8-iso Prostaglandin E2 isopropyl ester. In another embodiment, the pro-hair growth prostaglandin is 9-deoxy-9-methylene-16,16-dimethyl Prostaglandin E2. In another embodiment, the pro-hair growth prostaglandin is 9-deoxy-9-methylene Prostaglandin E2. In another embodiment, the pro-hair growth prostaglandin is ent-Prostaglandin E2. In another embodiment, the pro-hair growth prostaglandin is Prostaglandin E2-biotinimide. In another embodiment, the pro-hair growth prostaglandin is Prostaglandin E2-d4. In another embodiment, the pro-hair growth prostaglandin is Prostaglandin E2 methyl ester. In another embodiment, the pro-hair growth prostaglandin is Prostaglandin E2 serinol amide. In another embodiment, the pro-hair growth prostaglandin is Sulprostone. In another embodiment, the pro-hair growth prostaglandin is selected from 11-deoxy-16,16-dimethyl Prostaglandin E2, 11-deoxy Prostaglandin E2, 11β-Prostaglandin E2, 13,14-dihydro-15-keto Prostaglandin E1-d4, 13,14-dihydro Prostaglandin E1-d4, 15(R)-15-methyl Prostaglandin E2, 15(R)-Prostaglandin E2, 15(S)-15-methyl Prostaglandin E2, 16-phenoxy tetranor Prostaglandin E2, 16-phenyl tetranor Prostaglandin E2, 20-ethyl Prostaglandin E2, 5-trans Prostaglandin E2, 8-iso Prostaglandin E2 isopropyl ester, 9-deoxy-9-methylene-16,16-dimethyl Prostaglandin E2, 9-deoxy-9-methylene Prostaglandin E2, ent-Prostaglandin E2, Prostaglandin E2-biotinimide, Prostaglandin E2-d4, Prostaglandin E2 methyl ester, Prostaglandin E2 serinol amide, and Sulprostone. In another embodiment, the prostaglandin E2 analogue is selected from 11-deoxy-16,16-dimethyl Prostaglandin E2, 11-deoxy Prostaglandin E2, 11β-Prostaglandin E2, 13,14-dihydro-15-keto Prostaglandin E1-d4, 13,14-dihydro Prostaglandin E1-d4, 15(R)-15-methyl Prostaglandin E2, 15(R)-Prostaglandin E2, 15(S)-15-methyl Prostaglandin E2, 16-phenoxy tetranor Prostaglandin E2, 16-phenyl tetranor Prostaglandin E2, 20-ethyl Prostaglandin E2, 5-trans Prostaglandin E2, 8-iso Prostaglandin E2 isopropyl ester, 9-deoxy-9-methylene-16,16-dimethyl Prostaglandin E2, 9-deoxy-9-methylene Prostaglandin E2, ent-Prostaglandin E2, Prostaglandin E2-biotinimide, Prostaglandin E2-d4, Prostaglandin E2 methyl ester, Prostaglandin E2 serinol amide, and Sulprostone. In another embodiment, the pro-hair growth prostaglandin is any other prostaglandin E2 analogue known in the art. In another embodiment, the pro-hair growth prostaglandin is any other agonistic prostaglandin E2 analogue known in the art. In another embodiment, the pro-hair growth prostaglandin is any other prostaglandin E2 analogue known in the art that mimics the action of prostaglandin E2. In another embodiment, a compound or composition that increases prostaglandin E2 levels or prostaglandin E2 synthesis is administered to the subject. Each possibility represents a separate embodiment of the present invention.

In another embodiment, the pro-hair growth prostaglandin is a prostaglandin F2a. In another embodiment, the pro-hair growth prostaglandin is a prostaglandin F2a analogue. In another embodiment, the pro-hair growth prostaglandin is Latanoprost (Xalatan). In another embodiment, the pro-hair growth prostaglandin is Isopropyl unoprostone (Rescula). In another embodiment, the pro-hair growth prostaglandin is 11-deoxy Prostaglandin F2α. In another embodiment, the pro-hair growth prostaglandin is 11β-13,14-dihydro-15-keto Prostaglandin F2α. In another embodiment, the pro-hair growth prostaglandin is 11β-Prostaglandin F2α-d4. In another embodiment, the pro-hair growth prostaglandin is 11β-Prostaglandin F2α Ethanolamide. In another embodiment, the pro-hair growth prostaglandin is 13,14-dihydro-15-keto Prostaglandin F2α isopropyl ester. In another embodiment, the pro-hair growth prostaglandin is 15-keto Prostaglandin F2α. In another embodiment, the pro-hair growth prostaglandin is 15(R)-Prostaglandin F2α. In another embodiment, the pro-hair growth prostaglandin is 16,16-dimethyl Prostaglandin F2α. In another embodiment, the pro-hair growth prostaglandin is 2,3-dinor-11β-Prostaglandin F2α. In another embodiment, the pro-hair growth prostaglandin is 2,3-dinor-8-iso Prostaglandin F2α. In another embodiment, the pro-hair growth prostaglandin is 8-iso-15(R)-Prostaglandin F2α. In another embodiment, the pro-hair growth prostaglandin is AL 8810 isopropyl ester. In another embodiment, the pro-hair growth prostaglandin is CAY10509 (Cayman Chemical, Ann Arbor, Mich.). In another embodiment, the pro-hair growth prostaglandin is CAY10510 (Cayman Chemical). In another embodiment, the pro-hair growth prostaglandin is Cloprostenol (sodium salt). In another embodiment, the pro-hair growth prostaglandin is ent-Prostaglandin F2α. In another embodiment, the pro-hair growth prostaglandin is Latanoprost-d4. In another embodiment, the pro-hair growth prostaglandin is Prostaglandin F2α Alcohol. In another embodiment, the pro-hair growth prostaglandin is Prostaglandin F2α-d4. In another embodiment, the pro-hair growth prostaglandin is Prostaglandin F2α-d9. In another embodiment, the pro-hair growth prostaglandin is Prostaglandin F2α diethyl amide. In another embodiment, the pro-hair growth prostaglandin is Prostaglandin F2α dimethyl amide. In another embodiment, the pro-hair growth prostaglandin is Prostaglandin F2α dimethyl amine. In another embodiment, the pro-hair growth prostaglandin is Prostaglandin F2α ethyl amide. In another embodiment, the pro-hair growth prostaglandin is Prostaglandin F2α isopropyl ester. In another embodiment, the pro-hair growth prostaglandin is Prostaglandin F2α methyl ester. In another embodiment, the pro-hair growth prostaglandin is Prostaglandin F2α serinol amide. In another embodiment, the pro-hair growth prostaglandin is Prostaglandin F2a (tromethamine salt). In another embodiment, the pro-hair growth prostaglandin is selected from Latanoprost (Xalatan), Isopropyl unoprostone (Rescula), 11-deoxy Prostaglandin F2α, 11β-13,14-dihydro-15-keto Prostaglandin F2α, 11β-Prostaglandin F2α-d4, 11β-Prostaglandin F2α Ethanolamide, 13,14-dihydro-15-keto Prostaglandin F2α isopropyl ester, 15-keto Prostaglandin F2α, 15(R)-Prostaglandin F2α, 16,16-dimethyl Prostaglandin F2α, 2,3-dinor-11β-Prostaglandin F2α, 2,3-dinor-8-iso Prostaglandin F2α, 8-iso-15(R)-Prostaglandin F2α, AL 8810 isopropyl ester, CAY10509, CAY10510, Cloprostenol (sodium salt), ent-Prostaglandin F2α, Latanoprost-d4, Prostaglandin F2α Alcohol, Prostaglandin F2α-d4, Prostaglandin F2α-d9, Prostaglandin F2α diethyl amide, Prostaglandin F2α dimethyl amide, Prostaglandin F2α dimethyl amine, Prostaglandin F2α ethyl amide, Prostaglandin F2α isopropyl ester, Prostaglandin F2a methyl ester, Prostaglandin F2α serinol amide, Prostaglandin F2α (tromethamine salt). In another embodiment, the prostaglandin F2α analogue is selected from Latanoprost (Xalatan), Isopropyl unoprostone (Rescula), 11-deoxy Prostaglandin F2α, 11β-13,14-dihydro-15-keto Prostaglandin F2α, 11β-Prostaglandin F2α-d4, 11β-Prostaglandin F2α Ethanolamide, 13,14-dihydro-15-keto Prostaglandin F2α isopropyl ester, 15-keto Prostaglandin F2α, 15(R)-Prostaglandin F2α, 16,16-dimethyl Prostaglandin F2α, 2,3-dinor-11β-Prostaglandin F2α, 2,3-dinor-8-iso Prostaglandin F2α, 8-iso-15(R)-Prostaglandin F2α, AL 8810 isopropyl ester, CAY10509, CAY10510, Cloprostenol (sodium salt), ent-Prostaglandin F2α, Latanoprost-d4, Prostaglandin F2α Alcohol, Prostaglandin F2α-d4, Prostaglandin F2α-d9, Prostaglandin F2α diethyl amide, Prostaglandin F2α dimethyl amide, Prostaglandin F2α dimethyl amine, Prostaglandin F2α ethyl amide, Prostaglandin F2α isopropyl ester, Prostaglandin F2α methyl ester, Prostaglandin F2α serinol amide, Prostaglandin F2α (tromethamine salt). In another embodiment, the pro-hair growth prostaglandin is any other prostaglandin F2α analogue known in the art. In another embodiment, the pro-hair growth prostaglandin is any other agonistic prostaglandin F2α analogue known in the art. In another embodiment, the pro-hair growth prostaglandin is any other prostaglandin F2α analogue known in the art that mimics the action of prostaglandin F2α. In another embodiment, a compound or composition that increases prostaglandin F2α levels or prostaglandin F2α synthesis is administered to the subject. Each possibility represents a separate embodiment of the present invention.

In another embodiment, the pro-hair growth prostaglandin is 11-keto Fluprostenol. In another embodiment, the pro-hair growth prostaglandin is 15-keto Latanoprost. In another embodiment, the pro-hair growth prostaglandin is 15-keto Latanoprost (free acid). In another embodiment, the pro-hair growth prostaglandin is 15(S)-Latanoprost. In another embodiment, the pro-hair growth prostaglandin is 5-trans Latanoprost. In another embodiment, the pro-hair growth prostaglandin is 9-keto Fluprostenol. In another embodiment, the pro-hair growth prostaglandin is Fluprostenol. In another embodiment, the pro-hair growth prostaglandin is Latanoprost-d4. In another embodiment, the pro-hair growth prostaglandin is Latanoprost ethyl amide-d4. In another embodiment, the pro-hair growth prostaglandin is Latanoprost (free acid). In another embodiment, the pro-hair growth prostaglandin is Latanoprost Lactol. In another embodiment, the pro-hair growth prostaglandin is Lumula. In another embodiment, the pro-hair growth prostaglandin is Prostaglandin F2α isopropyl ester. In another embodiment, the pro-hair growth prostaglandin is Unoprostone. In another embodiment, the pro-hair growth prostaglandin is Unoprostone isopropyl ester. In another embodiment, the pro-hair growth prostaglandin is selected from 11-keto Fluprostenol, 15-keto Latanoprost, 15-keto Latanoprost (free acid), 15(S)-Latanoprost, 5-trans Latanoprost, 9-keto Fluprostenol, Fluprostenol, Latanoprost-d4, Latanoprost ethyl amide-d4, Latanoprost (free acid), Latanoprost Lactol, Lumula, Prostaglandin F2α isopropyl ester, Unoprostone, Unoprostone isopropyl ester.

In another embodiment, the pro-hair growth prostaglandin is any other pro-hair growth prostaglandin. Each possibility represents a separate embodiment of the present invention.

In another embodiment, the present invention provides a pharmaceutical composition, comprising a COX-2 inhibitor and an inhibitor of prostaglandin D2 activity. In another embodiment, the pharmaceutical composition further comprises a pro-hair growth prostaglandin. In another embodiment, the pro-hair growth prostaglandin is a prostaglandin E1. In another embodiment, the pro-hair growth prostaglandin is a prostaglandin E2. In another embodiment, the pro-hair growth prostaglandin is a prostaglandin F2a. In another embodiment, the pro-hair growth prostaglandin is any other pro-hair growth prostaglandin known in the art. Each possibility represents a separate embodiment of the present invention.

In another embodiment, the present invention provides a pharmaceutical composition, comprising a COX-2 inhibitor and an downregulator of prostaglandin D2 levels. In another embodiment, the pharmaceutical composition further comprises a pro-hair growth prostaglandin. In another embodiment, the pro-hair growth prostaglandin is a prostaglandin E1. In another embodiment, the pro-hair growth prostaglandin is a prostaglandin E2. In another embodiment, the pro-hair growth prostaglandin is a prostaglandin F2a. In another embodiment, the pro-hair growth prostaglandin is any other pro-hair growth prostaglandin known in the art. Each possibility represents a separate embodiment of the present invention.

In another embodiment, the present invention provides a pharmaceutical composition, comprising a COX-2 inhibitor and a pro-hair growth prostaglandin. In another embodiment, the pro-hair growth prostaglandin is a prostaglandin E1. In another embodiment, the pro-hair growth prostaglandin is a prostaglandin E2. In another embodiment, the pro-hair growth prostaglandin is a prostaglandin F2a. In another embodiment, the pro-hair growth prostaglandin is any other pro-hair growth prostaglandin known in the art. Each possibility represents a separate embodiment of the present invention.

In another embodiment, the present invention provides a pharmaceutical composition, comprising an inhibitor of prostaglandin D2 activity and a pro-hair growth prostaglandin. In another embodiment, the pro-hair growth prostaglandin is a prostaglandin E1. In another embodiment, the pro-hair growth prostaglandin is a prostaglandin E2. In another embodiment, the pro-hair growth prostaglandin is a prostaglandin F2a. In another embodiment, the pro-hair growth prostaglandin is any other pro-hair growth prostaglandin known in the art. Each possibility represents a separate embodiment of the present invention.

In another embodiment, the present invention provides a pharmaceutical composition, comprising a downregulator of prostaglandin D2 levels and a pro-hair growth prostaglandin. In another embodiment, the pro-hair growth prostaglandin is a prostaglandin E1. In another embodiment, the pro-hair growth prostaglandin is a prostaglandin E2. In another embodiment, the pro-hair growth prostaglandin is a prostaglandin F2a. In another embodiment, the pro-hair growth prostaglandin is any other pro-hair growth prostaglandin known in the art. Each possibility represents a separate embodiment of the present invention.

In another embodiment, a method of present invention further comprises the step of disrupting the epidermis of the target scalp, eyebrow, or scarred region. In another embodiment, a method of present invention further comprises the step of abrading the target scalp, eyebrow, or scarred region. In another embodiment, a method of present invention further comprises the step of wounding the target scalp, eyebrow, or scarred region. In another embodiment, the epidermal disruption, wounding, or abrading is performed prior to a step of a method of the present invention. In another embodiment, the epidermal disruption, wounding, or abrading is performed simultaneously with a step of a method of the present invention. In another embodiment, the epidermal disruption, wounding, or abrading is performed concurrently with a step of a method of the present invention. In another embodiment, the epidermal disruption, wounding, or abrading is performed after a step of a method of the present invention. Methods for disrupting the epidermis, wounding, and abrading are well known in the art, and are described, for example in PCT International Application Serial No. PCT/US2006/011319, which is incorporated herein by reference. Each possibility represents a separate embodiment of the present invention.

In another embodiment of methods and compositions of the present invention, a scalp or skin in need is contacted with a compound or composition capable of inhibiting a prostaglandin D2 activity. In another embodiment, a scalp or skin in need is contacted with a compound or composition capable of inhibiting a signaling or receptor pathway downstream of prostaglandin D2. In another embodiment, a scalp or skin in need is contacted with a compound or composition capable of decreasing a level of a prostaglandin D2. In another embodiment, a scalp or skin in need is contacted with a compound or composition capable of inhibiting an activity of a prostaglandin D2 synthase enzyme. In another embodiment, a scalp or skin in need is contacted with a compound or composition capable of decreasing a level of a prostaglandin D2 synthase enzyme. In another embodiment, a scalp or skin in need is contacted with a compound or composition capable of increasing an activity of a target gene of the present invention. In another embodiment, a scalp or skin in need is contacted with a compound or composition capable of increasing an expression of a target gene of the present invention. Each possibility represents a separate embodiment of the present invention.

In another embodiment, the scalp or skin is directly contacted. In another embodiment, a compound or composition of the present invention is applied directly to the scalp or skin. In another embodiment, the scalp or skin is contacted indirectly. In another embodiment, a compound or composition of the present invention is administered to the subject, and then is brought into contact with the scalp or skin in need by a transport process. In another embodiment, the transport process is passive transport. In another embodiment, the transport process is active transport. In another embodiment, the transport process is a combination of passive and active transport. In another embodiment, the transport process is diffusion. In another embodiment, the transport process is mediated by the circulatory system. In another embodiment, the transport process is mediated by the lymph system. In another embodiment, the transport process is mediated by any other system known in the art. Each possibility represents a separate embodiment of the present invention.

In one embodiment, a scalp is treated by a method of the present invention. In another embodiment, an eyebrow is treated. In another embodiment, a scarred region is treated. In another embodiment, any other hair-bearing area or region of the skin is treated. Each possibility represents a separate embodiment of the present invention.

In another embodiment, the present invention provides a composition for treating baldness, the composition comprising a compound or composition that is effective to inhibit a prostaglandin D2 activity in the subject's scalp.

In another embodiment, the present invention provides a composition for treating baldness, the composition comprising a compound or composition that is effective to inhibit a signaling or receptor pathway downstream of prostaglandin D2 in the subject's scalp.

In another embodiment, the present invention provides a composition for treating baldness, the composition comprising a compound or composition that is effective to decrease the prostaglandin D2 level in the subject's scalp.

In another embodiment, the present invention provides a composition for treating baldness, the composition comprising a compound or composition that is effective to inhibit prostaglandin D2 accumulation in the subject's scalp.

In another embodiment, the present invention provides a composition for treating baldness, the composition comprising a compound or composition that is effective to inhibit an activity of a prostaglandin D2 synthase in the subject's scalp.

In another embodiment, the present invention provides a composition for treating baldness, the composition comprising a compound or composition that is effective to decrease a level of a prostaglandin D2 synthase enzyme in the subject's scalp.

In another embodiment, the present invention provides a composition for treating baldness, the composition comprising a compound or composition that is effective to increase an activity or level of a target gene of the present invention in the subject's scalp.

In another embodiment, the present invention provides a composition for treating baldness, the composition comprising a compound or composition that is effective to decrease an activity or level of a target gene of the present invention in the subject's scalp.

In another embodiment, a protein or gene of the present invention is homologous to a peptide disclosed herein. The terms "homology," "homologous," etc, when in reference to any protein or peptide, refer, in one embodiment, to a percentage of amino acid residues in the candidate sequence that are identical with the residues of a corresponding native polypeptide, after aligning the sequences and introducing gaps, if necessary, to achieve the maximum percent homology, and not considering any conservative substitutions as part of the sequence identity. Methods and computer programs for the alignment are well known in the art.

Homology is, in another embodiment, determined by computer algorithm for sequence alignment, by methods well described in the art. For example, computer algorithm analysis of nucleic acid sequence homology can include the utilization of any number of software packages available, such as, for example, the BLAST, DOMAIN, BEAUTY (BLAST Enhanced Alignment Utility), GENPEPT and TREMBL packages.

In another embodiment, "homology" refers to identity to a sequence selected from SEQ ID No: 1-251 of greater than 70%. In another embodiment, "homology" refers to identity to a sequence selected from SEQ ID No: 1-251 of greater than 72%. In another embodiment, "homology" refers to identity to one of SEQ ID No: 1-251 of greater than 75%. In another embodiment, "homology" refers to identity to a sequence selected from SEQ ID No: 1-251 of greater than 78%. In another embodiment, "homology" refers to identity to one of SEQ ID No: 1-251 of greater than 80%. In another embodiment, "homology" refers to identity to one of SEQ ID No: 1-251 of greater than 82%. In another embodiment, "homology" refers to identity to a sequence selected from SEQ ID No: 1-251 of greater than 83%. In another embodiment, "homology" refers to identity to one of SEQ ID No: 1-251 of greater than 85%. In another embodiment, "homology" refers to identity to one of SEQ ID No: 1-251 of greater than 87%. In another embodiment, "homology" refers to identity to a sequence selected from SEQ ID No: 1-251 of greater than 88%. In another embodiment, "homology" refers to identity to one of SEQ ID No: 1-251 of greater than 90%. In another embodiment, "homology" refers to identity to one of SEQ ID No: 1-251 of greater than 92%. In another embodiment, "homology" refers to identity to a sequence selected from SEQ ID No: 1-251 of greater than 93%. In another embodiment, "homology" refers to identity to one of SEQ ID No: 1-251 of greater than 95%. In another embodiment, "homology" refers to identity to a sequence selected from SEQ ID No: 1-251 of greater than 96%. In another embodiment, "homology" refers to identity to one of SEQ ID No: 1-251 of greater than 97%. In another embodiment, "homology" refers to identity to one of SEQ ID No: 1-251 of greater than 98%. In another embodiment, "homology" refers to identity to one of SEQ ID No: 1-251 of greater than 99%. In another embodiment, "homology" refers to identity to one of SEQ ID No: 1-251 of 100%. Each possibility represents a separate embodiment of the present invention.

In another embodiment, "homology" refers to identity to a sequence selected from SEQ ID No: 252-276 of greater than 70%. In another embodiment, "homology" refers to identity to a sequence selected from SEQ ID No: 252-276 of greater than 72%. In another embodiment, "homology" refers to identity to one of SEQ ID No: 252-276 of greater than 75%. In another embodiment, "homology" refers to identity to a sequence selected from SEQ ID No: 252-276 of greater than 78%. In another embodiment, "homology" refers to identity to one of SEQ ID No: 252-276 of greater than 80%. In another embodiment, "homology" refers to identity to one of SEQ ID No: 252-276 of greater than 82%. In another embodiment, "homology" refers to identity to a sequence selected from SEQ ID No: 252-276 of greater than 83%. In another embodiment, "homology" refers to identity to one of SEQ ID No: 252-276 of greater than 85%. In another embodiment, "homology" refers to identity to one of SEQ ID No: 252-276 of greater than 87%. In another embodiment, "homology" refers to identity to a sequence selected from SEQ ID No: 252-276 of greater than 88%. In another embodiment, "homology" refers to identity to one of SEQ ID No: 252-276 of greater than 90%. In another embodiment, "homology" refers to identity to one of SEQ ID No: 252-276 of greater than 92%. In another embodiment, "homology" refers to identity to a sequence selected from SEQ ID No: 252-276 of greater than 93%. In another embodiment, "homology" refers to identity to one of SEQ ID No: 252-276 of greater than 95%. In another embodiment, "homology" refers to identity to a sequence selected from SEQ ID No: 252-276 of greater than 96%. In another embodiment, "homology" refers to identity to one of SEQ ID No: 252-276 of greater than 97%. In another embodiment, "homology" refers to identity to one of SEQ ID No: 252-276 of greater than 98%. In another embodiment, "homology" refers to identity to one of SEQ ID No: 252-276 of greater than 99%. In another embodiment, "homology" refers to identity to one of SEQ ID No: 252-276 of 100%. Each possibility represents a separate embodiment of the present invention.

In another embodiment, "homology" refers to identity to a sequence selected from SEQ ID No: 277-303 of greater than 70%. In another embodiment, "homology" refers to identity to a sequence selected from SEQ ID No: 277-303 of greater than 72%. In another embodiment, "homology" refers to identity to one of SEQ ID No: 277-303 of greater than 75%. In another embodiment, "homology" refers to identity to a sequence selected from SEQ ID No: 277-303 of greater than 78%. In another embodiment, "homology" refers to identity to one of SEQ ID No: 277-303 of greater than 80%. In another embodiment, "homology" refers to identity to one of SEQ ID No: 277-303 of greater than 82%. In another embodiment, "homology" refers to identity to a sequence selected from SEQ ID No: 277-303 of greater than 83%. In another embodiment, "homology" refers to identity to one of SEQ ID No: 277-303 of greater than 85%. In another embodiment, "homology" refers to identity to one of SEQ ID No: 277-303 of greater than 87%. In another embodiment, "homology" refers to identity to a sequence selected from SEQ ID No: 277-303 of greater than 88%. In another embodiment, "homology" refers to identity to one of SEQ ID No: 277-303 of greater than 90%. In another embodiment, "homology" refers to identity to one of SEQ ID No: 277-303 of greater than 92%. In another embodiment, "homology" refers to identity to a sequence selected from SEQ ID No: 277-303 of greater than 93%. In another embodiment, "homology" refers to identity to one of SEQ ID No: 277-303 of greater than 95%. In another embodiment, "homology" refers to identity to a sequence selected from SEQ ID No: 277-303 of greater than 96%. In another embodiment, "homology" refers to identity to one of SEQ ID No: 277-303 of greater than 97%. In another embodiment, "homology" refers to identity to one of SEQ ID No: 277-303 of greater than 98%. In another embodiment, "homology" refers to identity to one of SEQ ID No: 277-303 of greater than 99%. In another embodiment, "homology" refers to identity to one of SEQ ID No: 277-303 of 100%. Each possibility represents a separate embodiment of the present invention.

In another embodiment, "homology" refers to identity to a sequence selected from SEQ ID No: 304-317 of greater than 70%. In another embodiment, "homology" refers to identity to a sequence selected from SEQ ID No: 304-317 of greater than 72%. In another embodiment, "homology" refers to identity to one of SEQ ID No: 304-317 of greater than 75%. In another embodiment, "homology" refers to identity to a sequence selected from SEQ ID No: 304-317 of greater than 78%. In another embodiment, "homology" refers to identity to one of SEQ ID No: 304-317 of greater than 80%. In another embodiment, "homology" refers to identity to one of SEQ ID No: 304-317 of greater than 82%. In another embodiment, "homology" refers to identity to a sequence selected from SEQ ID No: 304-317 of greater than 83%. In another embodiment, "homology" refers to identity to one of SEQ ID No: 304-317 of greater than 85%. In another embodiment, "homology" refers to identity to one of SEQ ID No: 304-317 of greater than 87%. In another embodiment, "homology" refers to identity to a sequence selected from SEQ ID No: 304-317 of greater than 88%. In another embodiment, "homology" refers to identity to one of SEQ ID No: 304-317 of greater than 90%. In another embodiment, "homology" refers to identity to one of SEQ ID No: 304-317 of greater than 92%. In another embodiment, "homology" refers to identity to a sequence selected from SEQ ID No: 304-317 of greater than 93%. In another embodiment, "homology" refers to identity to one of SEQ ID No: 304-317 of greater than 95%. In another embodiment, "homology" refers to identity to a sequence selected from SEQ ID No: 304-317 of greater than 96%. In another embodiment, "homology" refers to identity to one of SEQ ID No: 304-317 of greater than 97%. In another embodiment, "homology" refers to identity to one of SEQ ID No: 304-317 of greater than 98%. In another embodiment, "homology" refers to identity to one of SEQ ID No: 304-317 of greater than 99%. In another embodiment, "homology" refers to identity to one of SEQ ID No: 304-317 of 100%. Each possibility represents a separate embodiment of the present invention.

In another embodiment, "homology" refers to identity to a sequence selected from SEQ ID No: 318-323 of greater than 70%. In another embodiment, "homology" refers to identity to a sequence selected from SEQ ID No: 318-323 of greater than 72%. In another embodiment, "homology" refers to identity to one of SEQ ID No: 318-323 of greater than 75%. In another embodiment, "homology" refers to identity to a sequence selected from SEQ ID No: 318-323 of greater than 78%. In another embodiment, "homology" refers to identity to one of SEQ ID No: 318-323 of greater than 80%. In another embodiment, "homology" refers to identity to one of SEQ ID No: 318-323 of greater than 82%. In another embodiment, "homology" refers to identity to a sequence selected from SEQ ID No: 318-323 of greater than 83%. In another embodiment, "homology" refers to identity to one of SEQ ID No: 318-323 of greater than 85%. In another embodiment, "homology" refers to identity to one of SEQ ID No: 318-323 of greater than 87%. In another embodiment, "homology" refers to identity to a sequence selected from SEQ ID No: 318-323 of greater than 88%. In another embodiment, "homology" refers to identity to one of SEQ ID No: 318-323 of greater than 90%. In another embodiment, "homology" refers to identity to one of SEQ ID No: 318-323 of greater than 92%. In another embodiment, "homology" refers to identity to a sequence selected from SEQ ID No: 318-323 of greater than 93%. In another embodiment, "homology" refers to identity to one of SEQ ID No: 318-323 of greater than 95%. In another embodiment, "homology" refers to identity to a sequence selected from SEQ ID No: 318-323 of greater than 96%. In another embodiment, "homology" refers to identity to one of SEQ ID No: 318-323 of greater than 97%. In another embodiment, "homology" refers to identity to one of SEQ ID No: 318-323 of greater than 98%. In another embodiment, "homology" refers to identity to one of SEQ ID No: 318-323 of greater than 99%. In another embodiment, "homology" refers to identity to one of SEQ ID No: 318-323 of 100%. Each possibility represents a separate embodiment of the present invention.

In another embodiment, homology is determined via determination of candidate sequence hybridization, methods of which are well described in the art (See, for example, "Nucleic Acid Hybridization" Hames, B. D., and Higgins S. J., Eds. (1985); Sambrook et al., 2001, Molecular Cloning, A Laboratory Manual, Cold Spring Harbor Press, N.Y.; and Ausubel et al., 1989, Current Protocols in Molecular Biology, Green Publishing Associates and Wiley Interscience, N.Y). In other embodiments, methods of hybridization are carried out under moderate to stringent conditions, to the complement of a DNA encoding a native caspase peptide. Hybridization conditions being, for example, overnight incubation at 42° C. in a solution comprising: 10-20% formamide, 5×SSC (150 mM NaCl, 15 mM trisodium citrate), 50 mM sodium phosphate (pH 7. 6), 5×Denhardt's solution, 10% dextran sulfate, and 20 µg/ml denatured, sheared salmon sperm DNA.

In another embodiment of the present invention, "nucleic acids" or "nucleotide" refers to a string of at least two base-sugar-phosphate combinations. The term includes, in one embodiment, DNA and RNA. "Nucleotides" refers, in one embodiment, to the monomeric units of nucleic acid polymers. RNA is, in one embodiment, in the form of a tRNA (transfer RNA), snRNA (small nuclear RNA), rRNA (ribosomal RNA), mRNA (messenger RNA), anti-sense RNA, small inhibitory RNA (siRNA), micro RNA (miRNA) and ribozymes. The use of siRNA and miRNA has been described (Caudy A A et al, Genes & Devel 16: 2491-96 and references cited therein). DNA can be, in other embodiments, in form of plasmid DNA, viral DNA, linear DNA, or chromosomal DNA or derivatives of these groups. In addition, these forms of DNA and RNA can be single, double, triple, or quadruple stranded. The term also includes, in another embodiment, artificial nucleic acids that contain other types of backbones but the same bases. In one embodiment, the artificial nucleic acid is a PNA (peptide nucleic acid). PNA contain peptide backbones and nucleotide bases and are able to bind, in one embodiment, to both DNA and RNA molecules. In another embodiment, the nucleotide is oxetane modified. In another embodiment, the nucleotide is modified by replacement of one or more phosphodiester bonds with a phosphorothioate bond. In another embodiment, the artificial nucleic acid contains any other variant of the phosphate backbone of native nucleic acids known in the art. The use of phosphothiorate nucleic acids and PNA are known to those skilled in the art, and are described in, for example, Neilsen P E, Curr Opin Struct Biol 9:353-57; and Raz N K et al Biochem Biophys Res Commun. 297:1075-84. The production and use of nucleic acids is known to those skilled in art and is described, for example, in Molecular Cloning, (2001), Sambrook and Russell, eds. and Methods in Enzymology: Methods for molecular cloning in eukaryotic cells (2003) Purchio and G. C. Fareed. Each nucleic acid derivative represents a separate embodiment of the present invention.

Protein and/or peptide homology for any amino acid sequence listed herein is determined, in another embodiment, by methods well described in the art, including immunoblot analysis, or via computer algorithm analysis of amino acid sequences, utilizing any of a number of software packages available, via established methods. Some of these packages include the FASTA, BLAST, MPsrch or Scanps packages, and, in another embodiment, employ the use of the Smith and Waterman algorithms, and/or global/local or BLOCKS alignments for analysis, for example. Each method of determining homology represents a separate embodiment of the present invention.

In another embodiment, the present invention provides a kit comprising a reagent utilized in performing a method of the present invention. In another embodiment, the present invention provides a kit comprising a composition, tool, or instrument of the present invention.

Pharmaceutical Compositions and Methods of Administration

In another embodiment, methods of the present invention comprise the step of administering a pharmaceutical composition containing a compound or composition of the present invention. "Pharmaceutical composition" refers, in another embodiment, to a therapeutically effective amount of the active ingredient, together with a pharmaceutically acceptable carrier or diluent. A "therapeutically effective amount" refers, in one embodiment, to that amount which provides a therapeutic effect for a given condition and administration regimen.

The pharmaceutical compositions containing the compound or composition can be, in another embodiment, administered to a subject by any method known to a person skilled in the art, such as parenterally, paracancerally, transmucosally, transdermally, intramuscularly, intravenously, intra-dermally, subcutaneously, intra-peritonealy, intra-ventricularly, intra-cranially, intra-vaginally or intra-tumorally.

In another embodiment, the pharmaceutical composition is administered topically to body surfaces and is thus formulated in a form suitable for topical administration. In another embodiment, the pharmaceutical composition is administered to the target scalp, skin, or hair-bearing region. Suitable topical formulations include, in another embodiment, gels, ointments, creams, lotions, drops and the like. For topical administration, the compound or composition is prepared and applied as a solution, suspension, or emulsion in a physiologically acceptable diluent with or without a pharmaceutical carrier.

In another embodiment of methods and compositions of the present invention, the pharmaceutical compositions are administered orally, and are thus formulated in a form suitable for oral administration, i.e. as a solid or a liquid preparation. Suitable solid oral formulations include tablets, capsules, pills, granules, pellets and the like. Suitable liquid oral formulations include solutions, suspensions, dispersions, emulsions, oils and the like. In another embodiment of the present invention, the active ingredient is formulated in a capsule. In accordance with this embodiment, the compositions of the present invention comprise, in addition to the active compound and the inert carrier or diluent, a hard gelating capsule.

In another embodiment, the pharmaceutical compositions are administered by intravenous, intra-arterial, or intra-muscular injection of a liquid preparation. Suitable liquid formulations include solutions, suspensions, dispersions, emulsions, oils and the like. In another embodiment, the pharmaceutical compositions are administered intravenously and are thus formulated in a form suitable for intravenous administration. In another embodiment, the pharmaceutical compositions are administered intra-arterially and are thus formulated in a form suitable for intra-arterial administration. In another embodiment, the pharmaceutical compositions are administered intra-muscularly and are thus formulated in a form suitable for intra-muscular administration.

In another embodiment, the pharmaceutical composition is administered as a suppository, for example a rectal suppository or a urethral suppository. In another embodiment, the pharmaceutical composition is administered by subcutaneous implantation of a pellet. In another embodiment, the pellet provides for controlled release of active agent over a period of time.

In another embodiment, the active compound is delivered in a vesicle, e.g. a liposome.

In other embodiments, carriers or diluents used in methods of the present invention include, but are not limited to, a gum, a starch (e.g. corn starch, pregeletanized starch), a sugar (e.g., lactose, mannitol, sucrose, dextrose), a cellulosic material (e.g. microcrystalline cellulose), an acrylate (e.g. polymethylacrylate), calcium carbonate, magnesium oxide, talc, or mixtures thereof.

In other embodiments, pharmaceutically acceptable carriers for liquid formulations are aqueous or non-aqueous solutions, suspensions, emulsions or oils. Examples of non-aqueous solvents are propylene glycol, polyethylene glycol, and injectable organic esters such as ethyl oleate. Aqueous carriers include water, alcoholic/aqueous solutions, emulsions or suspensions, including saline and buffered media. Examples of oils are those of animal, vegetable, or synthetic origin, for example, peanut oil, soybean oil, olive oil, sunflower oil, fish-liver oil, another marine oil, or a lipid from milk or eggs.

In another embodiment, parenteral vehicles (for subcutaneous, intravenous, intranrterial, or intramuscular injection) include sodium chloride solution, Ringer's dextrose, dextrose and sodium chloride, lactated Ringer's and fixed oils. Intravenous vehicles include fluid and nutrient replenishers, electrolyte replenishers such as those based on Ringer's dextrose, and the like. Examples are sterile liquids such as water and oils, with or without the addition of a surfactant and other pharmaceutically acceptable adjuvants. In general, water, saline, aqueous dextrose and related sugar solutions, and glycols such as propylene glycols or polyethylene glycol are preferred liquid carriers, particularly for injectable solutions. Examples of oils are those of animal, vegetable, or synthetic origin, for example, peanut oil, soybean oil, olive oil, sunflower oil, fish-liver oil, another marine oil, or a lipid from milk or eggs.

In other embodiments, the compositions further comprise binders (e.g. acacia, cornstarch, gelatin, carbomer, ethyl cellulose, guar gum, hydroxypropyl cellulose, hydroxypropyl methyl cellulose, povidone), disintegrating agents (e.g. cornstarch, potato starch, alginic acid, silicon dioxide, croscarmelose sodium, crospovidone, guar gum, sodium starch glycolate), buffers (e.g., Tris-HCL, acetate, phosphate) of various pH and ionic strength, additives such as albumin or gelatin to prevent absorption to surfaces, detergents (e.g., Tween 20, Tween 80, Pluronic F68, bile acid salts), protease inhibitors, surfactants (e.g. sodium lauryl sulfate), permeation enhancers, solubilizing agents (e.g., glycerol, polyethylene glycerol), anti-oxidants (e.g., ascorbic acid, sodium metabisulfite, butylated hydroxyanisole), stabilizers (e.g. hydroxypropyl cellulose, hyroxypropylmethyl cellulose), viscosity increasing agents (e.g. carbomer, colloidal silicon dioxide, ethyl cellulose, guar gum), sweeteners (e.g. aspartame, citric acid), preservatives (e.g., Thimerosal, benzyl alcohol, parabens), lubricants (e.g. stearic acid, magnesium stearate, polyethylene glycol, sodium lauryl sulfate), flow-aids (e.g. colloidal silicon dioxide), plasticizers (e.g. diethyl phthalate, triethyl citrate), emulsifiers (e.g. carbomer, hydroxypropyl cellulose, sodium lauryl sulfate), polymer coatings (e.g., poloxamers or poloxamines), coating and film forming agents (e.g. ethyl cellulose, acrylates, polymethacrylates) and/or adjuvants. Each of the above excipients represents a separate embodiment of the present invention.

In another embodiment, the pharmaceutical compositions provided herein are controlled-release compositions, i.e. compositions in which the active compound is released over a period of time after administration. Controlled- or sustained-release compositions include formulation in lipophilic depots (e.g. fatty acids, waxes, oils). In another embodiment, the composition is an immediate-release composition, i.e. a composition in which all the active compound is released immediately after administration.

The preparation of pharmaceutical compositions that contain an active component, for example by mixing, granulating, or tablet-forming processes, is well understood in the art. The active therapeutic ingredient is often mixed with excipients that are pharmaceutically acceptable and compatible with the active ingredient. For oral administration, the active agent is mixed with additives customary for this purpose, such as vehicles, stabilizers, or inert diluents, and converted by customary methods into suitable forms for administration, such as tablets, coated tablets, hard or soft gelatin capsules, aqueous, alcoholic or oily solutions. For parenteral administration, the active agent is converted into a solution, suspension, or emulsion, if desired with the substances customary and suitable for this purpose, for example, solubilizers or other substances.

Each of the above additives, excipients, formulations and methods of administration represents a separate embodiment of the present invention.

EXPERIMENTAL DETAILS SECTION

Example 1: Histopathology of Androgenetic Alopecia Materials and Experimental Methods
(Examples 1-5)

Tissue Samples

Human scalp samples were obtained from 8 subjects during hair transplantation, with approval of the University of Pennsylvania Institutional Review Board. During the procedure, 2 millimeter mm wide by several centimeter (cm) long specimens are taken from the donor scalp, and then dissected into various graft sizes (single hair grafts to multiple hair grafts). Some tissue is deemed unsatisfactory for transplantation, due to inadvertent sectioning, for example. These discarded donor samples were used as haired specimens. Likewise, 1.2 mm and 1.7 mm diameter bald scalp cylindrical "punches" are performed to create vacant recipient sites for donor scalp, which was used as the bald samples. Subjects were 40-63 year old Caucasian males not using using minoxidil or finasteride. For RNA isolation, paired samples from 5 patients were stored in RNA Later® (Qiagen). For flow cytometry, paired samples from 3 patients were kept at 4° C. in DMEM+streptomycin and fungazone (GIBCO) until use. Scalp excisions used for in situ hybridization were provided by the University of Pennsylvania Human Cooperative Tissue Network.

Flow Cytometry

Samples were treated with 2.5 U/ml of Dispase (Sigma) in DMEM with 0.3% FBS, gentamycin and 0.01M HEPES overnight. The epidermis was gently removed from the dermis, with simultaneous removal of hair shafts. With removal of individual hair shafts, the surrounding follicle keratinocytes were likewise separated from dermis. Bald scalp follicles were also carefully separated individually. Isolated epidermis was then washed in PBS, and treated with Trypsin for 20 minutes at 37° C. in the presence of DNAase. The sample was vortexed gently and filtered trough a sterile 70 μm filter. Cells were spun at 200×g for 5 minutes and washed twice with PBS. Cells were counted using a hemocytometer. For every stage of the above procedure, tissue was saved for monitoring of successful purification by hematoxylin and eosin staining. 600,000 cells were used for counting each sample with attempts made to quantify the maximum possible during flow analysis. Samples were stained with antibodies to alpha-6 integrin (Pharmingen, San Jose, Calif., Clone GoH3), fixed and permeabilized (Caltag labs, Burlingame, Calif.), and stained with antibodies against ACTIN (Sigma clone AC-15). KRT15 (Lab Vision clone LHK15), FST (R&D Systems Clone 85918) and with an isotype control (IgG2a Sigma). Isotype, KRT15 and FST antibodies were pre-labeled with chromophores preconjugated to Fab (Zenon Tricolor IgG2a kit). The antibody to ACTIN was directly conjugated to FITC by the manufacturer. Cells were counted on a Becton Dickson FACSCalibur® machine using the Cell Quest® application (BD Biosciences, San Jose Calif.). FITC, PE and PerCP channels were detected using the respective bandpass filters (530/30, 575/26, 695/45), after excitation from a 488 15 mW argon laser. Data was analyzed with FloJo® (Treestar) software. For each patient tested, identical gating was used for all samples using the same antibodies.

Target Preparation and Hybridization 5 microgram (mcg) total RNA was converted to first-strand cDNA using Superscript II reverse transcriptase primed by a poly(T) oligomer that incorporated the T7 promoter. Second-strand cDNA synthesis was followed by in vitro transcription for linear amplification of each transcript and incorporation of biotinylated CTP and UTP. The cRNA products were fragmented to 200 nucleotides or less, heated at 99° C. for 5 min and hybridized for 16 h at 45° C. to U133A Affymetrix microarrays (Human Genome U133A Array). The microarrays were then washed at low (6×SSPE) and high (100 millimolar (mM) MES, 0.1M NaCl) stringency and stained with streptavidin-phycoerythrin. Fluorescence was amplified by adding biotinylated anti-streptavidin and an additional aliquot of streptavidin-phycoerythrin stain. A confocal scanner was used to collect fluorescence signal at 3 micrometer (mcm) resolution after excitation at 570 nm. The average signal from 2 sequential scans was calculated for each microarray feature.

Initial Data Analysis

Affymetrix GeneChip® Operating System (GCOS, v. 1.4, Affymetrix, Inc.) was used to quantitate expression signal levels for the arrays; default values provided by Affymetrix were applied to all analysis parameters. Border pixels were removed, and the average intensity of pixels within the 75th percentile was computed for each probe. These values were exported as .cel files. The average of the lowest 2% of probe intensities occurring in each of 16 microarray sectors was set as background and subtracted from all features in that sector. Probe pairs were scored positive or negative for detection of the targeted sequence by comparing signals from the perfect match and mismatch probe features. The number of probe pairs meeting the default discrimination threshold (tau=0.015) was used to assign a call of absent, present or marginal for each assayed gene, and a p-value was calculated to reflect confidence in the detection call. The flag values were additionally exported in .chp files.

Affymetrix probe intensities were imported into GeneSpring® (v7.2, Agilent Technologies) where probeset signal values were calculated using the GC-RMA algorithm. Upon import of the Affymetrix flag values, the probesets were filtered to retain only those that were flagged P (present) in at least two of the 10 samples. This list was used for condition-based principle components analysis (PCA) to assess global trends in sample similarity. This analysis demonstrated groupings based on both patient and processing date, and prompted the use of mixed-model 3-way ANOVA as a means of finding differentially regulated genes between the sites of interest.

GC-RMA signal data was imported into Partek Genomics Solution® (PGS, v6.2, Partek, Inc.), where the data were $log_2$ transformed, and a 3-way mixed model ANOVA was applied. Location (bald or haired) was considered a fixed effect, while patient and processing date were considered random effects. Probesets were ranked by ascending p-values for the "location" term of the ANOVA, thereby prioritizing genes that best differentiated between bald and haired scalp. The top 250 probesets, having a false discovery rate (FDR, by the "step-down" method implemented in PGS) of less than 18% were retained for further analysis. This list was imported to GeneSpring® for further analysis, visualization and hierarchical clustering of both genes and samples. Fold change was calculated by taking the geometric mean of the 5 haired/bald patient-paired ratios for each gene (using GC-RMA signal values). Positive fold changes indicate greater relative expression in the haired scalp, and negative values indicate greater expression in the bald scalp. 169 probesets were found to be higher in haired scalp, and 81 were found to be higher in bald scalp.

As a further validation of the relationship among the samples, a 10×10 pairwise correlation matrix was calculated using $log_2$ transformed GC-RMA data from which the batch effects of patient and processing date had been removed (PGS, using the same 3-way mixed model ANOVA described above). The mean and standard deviation for all haired-haired, haired-bald and bald-bald paired correlations were calculated (excluding self-self pairs).

Annotations for the 251 probesets were mined using the DAVID functional annotation tool (Dennis G et al. DAVID: Database for Annotation, Visualization, and Integrated Discovery. Genome Biol. 2003; 4(5):P3 The lists of 169 and 81 genes were analyzed separately, and were scored for their overrepresentation of Gene Ontology Biological Processes (GO_BP_All) categories with a minimum of 5 genes per category.

In Situ Hybridization

All primers used to generate probes are depicted in FIG. 8. Anti-sense PCR-derived probe templates were constructed to contain the T7 promoter. Amplified probe templates were purified in agarose gel via QIAquick® extraction kit (Qiagen, Chatsworth, Calif.). Purified products were converted to digoxin-containing riboprobes with the DIG RNA labeling kit (Roche, Indianapolis, Ind.) according to the manufacturer's instructions. Paraformaldehyde (PFA)-fixed, paraffin-embedded tissue from scalp excisions from haired scalp. No tissue from patients participating in array or flow cytometry experiments was used. Embedded tissue was removed of paraffin with xylene and rehydrated. Tissue was permeabilized with proteinase K (Roche, Indianapolis, Ind.) and re-fixed in 4% PFA followed by acetylation in acetic anhydride and triethanolamine. Sections were pre-hybridized for 2 hours, and then hybridized with 500-1000 ng/ml of probe for 16 hours. Slides were subsequently washed, blocked, treated with antibodies to digoxin preconjugated to alkaline phosphatase (Roche, Indianapolis, Ind.), and developed with NBT and BCIP (Roche, Indianapolis, Ind.).

Immunohistochemistry

Tissue was from different subjects than those used for microarray or flow cytometry experiments. Briefly, PFA-fixed, paraffin-embedded slides containing human scalp hair from excisions were de-parafinized and rehydrated. Microwave antigen retrieval was used with 10 mM citrate buffer (pH 6.8). Slides were treated with hydrogen peroxidase to block endogenous horseradish peroxidase activity, washed, and treated with blocking reagent and then primary antibody (chicken anti-KRT15 at 1:200, Covance), washed, treated with secondary biotinylated anti-chicken antibody (Kirkegaard and Perry Laboratories, Inc), washed, treated with streptavidin-HRP (Vectastain, Burlingame Calif.), and developed using DAB(3,3-diaminobenzidine).

Results

Figure 1D:
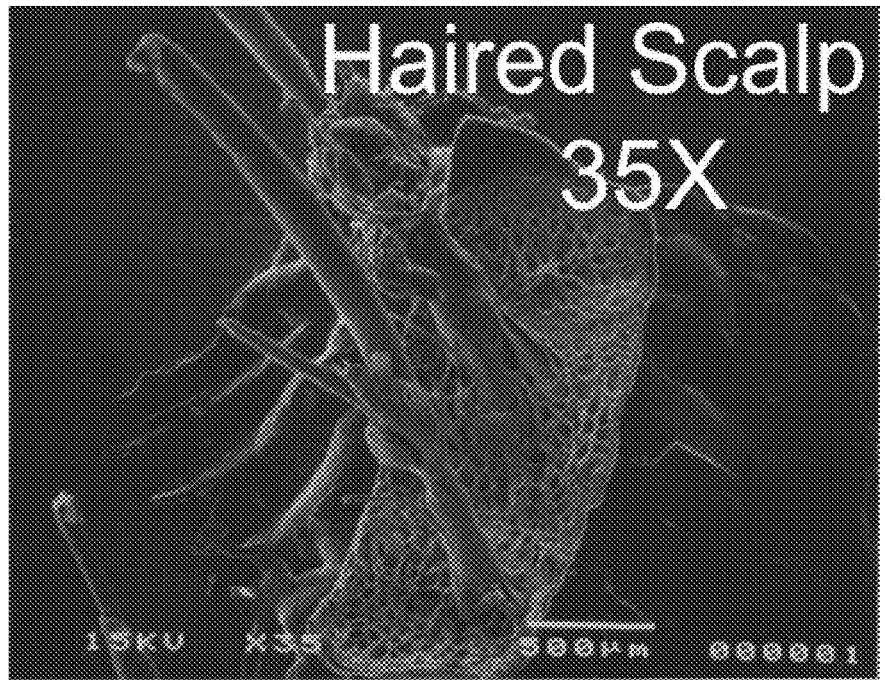
Figure 1E:
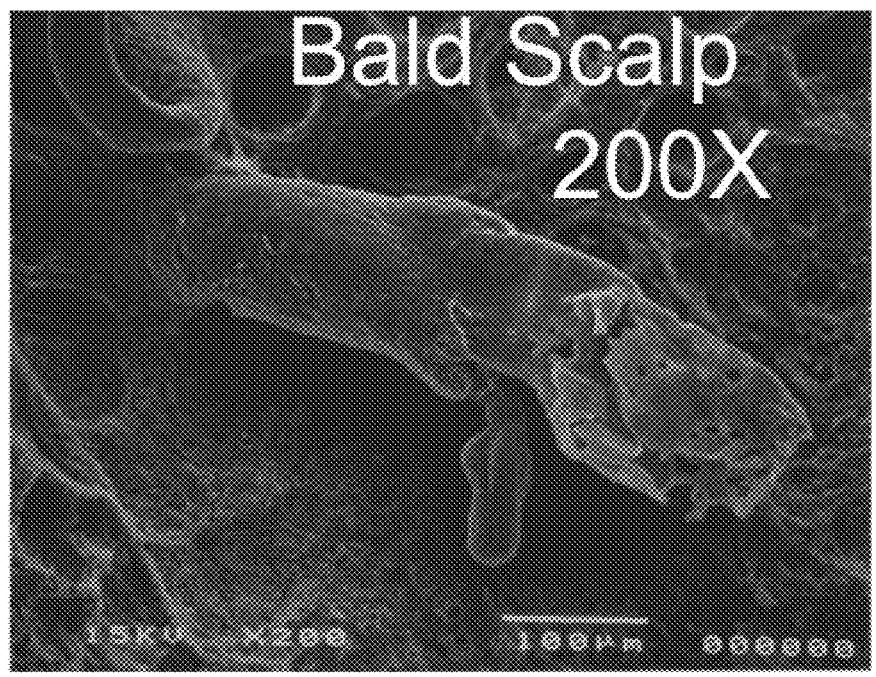

Haired and bald human scalp was procured from individuals undergoing hair transplantation, and representative tissue was examined histologically to confirm the presence of haired and bald scalp (FIG. 1A-B, respectively). Bald scalp exhibited a larger number of miniaturized, vellus-like hair follicles (HF) that satisfied the formal definition of a reduction from the minimum normal hair diameter of 0.08 mm to <0.06 mm. Generally there was a large variation in size of sectioned follicles in the bald scalp. Occasional follicles demonstrated fibroplasia in the inferior portion of the follicle below the hair shaft (called fibrous streamers). There was also a decrease in the normal percentage (>93%) of anagen follicles. In addition, many follicles were found to have inflammatory infiltrates, which were composed of lymphocytes as well as mast cells, and were centered around the lower infundibulum of the HF. Hair follicle miniaturization was confirmed with scanning electron microscopy (SEM), which demonstrated dramatic miniaturization of follicles in the bald scalp (FIG. 1D-E).

None of the subjects showed histopathology consistent with other causes of inflammatory hair loss such as alopecia areata (lymphocytic infiltrates around bulbs of anagen follicles), or cicatricial alopecias (often lichenoid infiltrates associated with complete loss of follicular structures), confirming that the subjects had AGA.

Example 2: Suprabasal Bulge Cells, but not HF Stem Cells, are Depleted in Bald Scalp To determine whether destruction of HF stem cells accounted for follicle miniaturization, immuno-histochemical staining was performed on bald scalp with an antibody to KRT15, a marker for follicle stem cells. KRT15 expression was detected in the miniaturized follicles (FIG. 1C). To determine whether bald scalp exhibited changes in stem cell number, keratinocyte suspensions were stained for KRT15 and FST protein (both intracellularly) and were subjected to flow cytometry to identify bulge follicle stem cells. FST is also a marker for HF stem cells. Cells were also stained for the basal cell marker alpha-6 integrin.

Figure 2A:
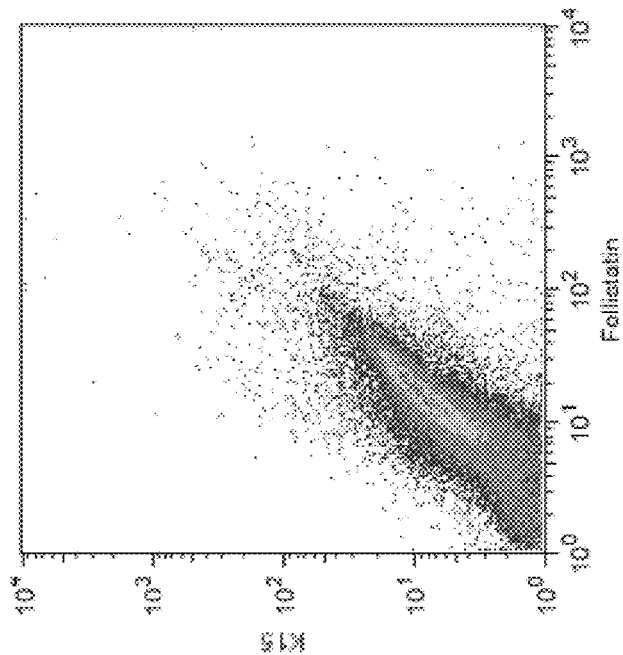
Figure 2B:
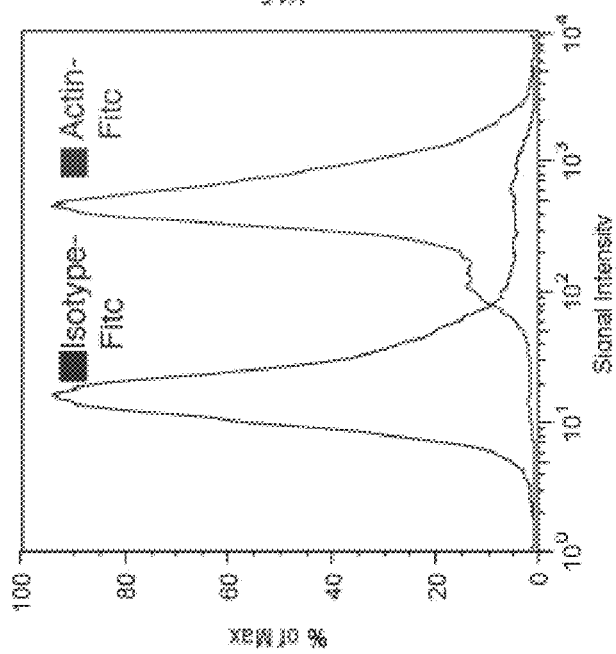

Cells were effectively permeabilized, as evidenced by the staining of over 90% of cells with antibodies against actin, in contrast to minimal staining from an unrelated isotype antibody (FIG. 2A). A high degree of overlap was observed between KRT15 and FST staining, with comparatively fewer single positive cells (KRT15$^+$/FST$^-$ or KRT15$^-$/FST$^+$) than double positive or double negative cells (KRT15$^+$/FST$^+$ or KRT15$^-$/FST$^-$) as shown by the slope of the KRT15 vs. FST plot, which was close to 1 (FIG. 2B). Haired samples from each patient yielded similar results.

Percentages of HF stem cells in the basal layer of the bulge, defined as KRT15$^+$ or FST$^+$ and alpha-6 integrin$^+$, were similar between haired and bald scalp for all three paired samples (FIG. 2). The percentage of the KRT15$^+$/alpha-6 integrin$^+$ population in the haired and bald scalp was, respectively, 2.12 vs. 2.39 in the 1$^{st}$ patient (FIG. 2C); 2.05 vs. 2.55 in the 2$^{nd}$ patient. Similarly, in the 3$^{rd}$ patient, the percentage of the FST$^+$/alpha-6 integrin$^+$ populations in haired and bald scalp were 1.52% vs. 1.38% (FIG. 2D). Thus, the number of follicular stem cells in bald versus non-bald scalp was essentially constant.

The KRT15$^+$ and FST$^+$ populations differed between the bald and haired scalp with respect to the distribution of alpha-6 integrin$^+$ cells. Fewer alpha-6 integrin$^-$ cells were found in the stem cell compartment of bald scalp. The percentages of the KRT15$^+$/alpha-6 integrin$^-$ population were 0.7% and 0.26% in haired and bald scalp, respectively, and the FST$^+$/alpha-6 integrin$^-$ population were 0.96% to 0.45%, respectively. Thus the ratio of KRT15$^+$/alpha-6 integrin$^+$ to KRT15$^+$/alpha-6 integrin$^-$ increased from 2.17 to 5.3 between haired and bald scalp, and the ratio of FST$^+$/alpha-6 integrin$^+$ to FST+/alpha-6 integrin$^-$ cells increased from 2.2 to 5.3. The 3$^{rd}$ subject exhibited a similar 2-fold increase in the ratio of KRT15$^+$/alpha-6 integrin$^+$ to KRT15$^+$/alpha-6 integrin$^-$ cells (1.55 vs. 2.97).

Thus, bald scalp exhibited a relative decrease in the proportion of alpha-6 integrin negative cells within the stem cell compartment.

Example 3: Haired and Bald Scalp Exhibit Increased Expression of Organogenesis and Inflammation Genes, Respectively To measure differences in stem cell marker expression between AGA and normal samples, RNA was isolated from haired and bald scalp samples from 5 patients, converted to cRNA, and probed with an Affymetrix® U133A chip, testing 22,215 probe sets. 12,786 probe sets were found to be expressed in at least one sample. After intensity readings were obtained for probe sets, geometric means were taken of the patient-specific ratios of haired to bald scalp. Data was analyzed with a 3-way ANOVA algorithm to assign p values (significance), based on the primary variable of haired vs. bald sample, while the variables of patient and date of experiment were considered as secondary random effects. All probe sets tested were then ordered according to p value of the differential expression from most to least significant. The top 251 genes according to statistical significance are depicted in FIG. 3. To corroborate the statistical test used, several additional tests were performed, as described below.

Figure 4:
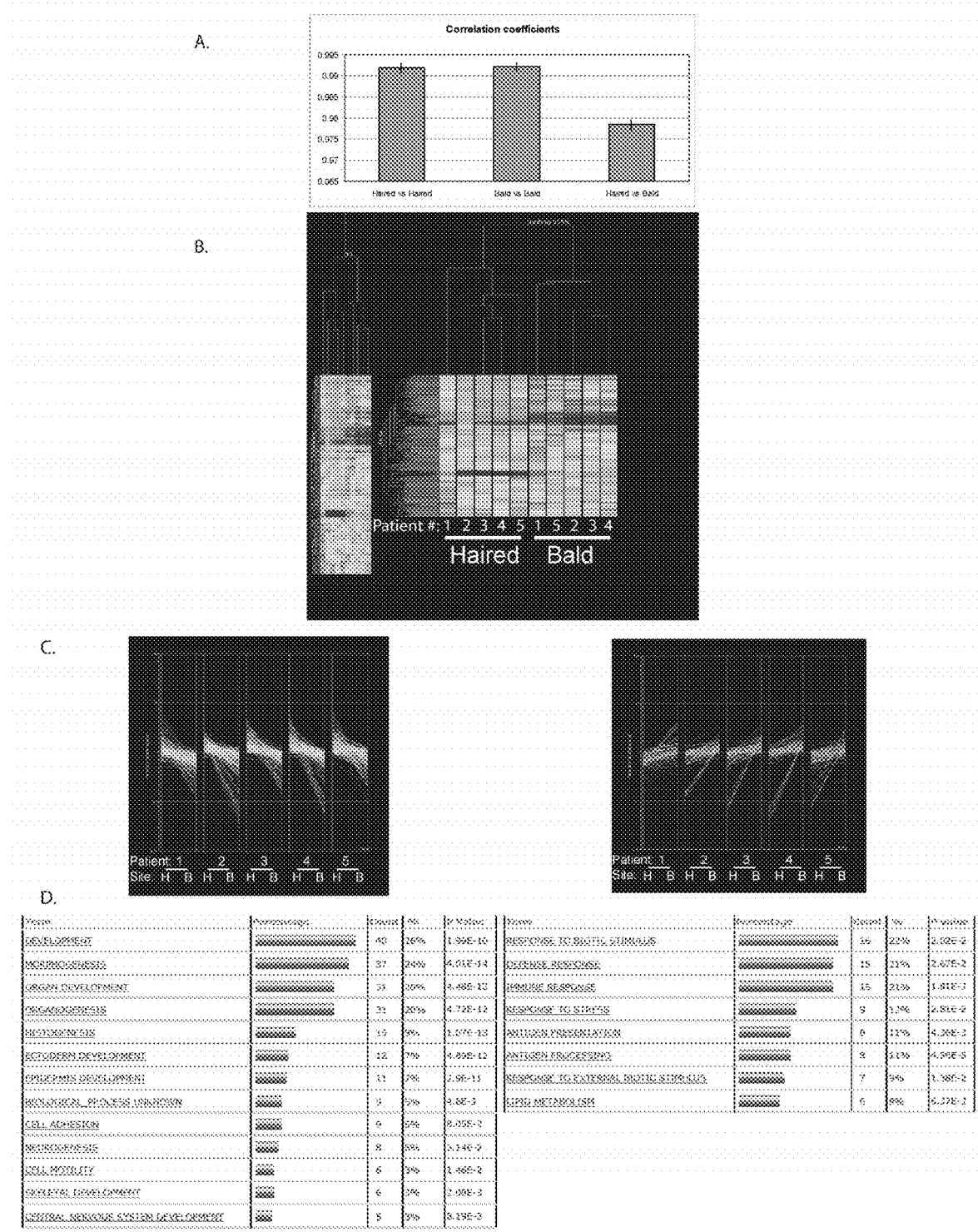
FIG. 4. Summary of haired and bald scalp gene expression profiles. A) Average correlation coefficients of haired vs. haired, bald vs. bald and haired vs. bald with standard errors. B) Gene clustering algorithm applied to the group of 10 samples, for the 250 genes with the most statistically significant differential expression. C) Genes whose averages are higher in the haired scalp (H) follow this pattern for all subjects (left); and genes whose averages are lower in the bald scalp (B) follow this pattern for all subjects (right). Depicted are discontinuous graphs (gene expression level: y axis; patient samples grouped as pairs along the x axis) for the 250 genes. First sample in each pair (beginning of line) is the haired scalp and second sample (end of line) is the bald scalp. D) Gene Ontology classifications for gene function ordered by numbers of probe sets in each category with p values.

First, correlation within duplicates of haired samples and within duplicates of bald samples was examined. High degrees of correlation were observed (FIG. 4A), indicating the success of the use of internal controls between patients. Secondly, all 10 samples were clustered according to common gene expression in a hierarchical analysis using the 250 most significant genes. Haired specimens and bald samples were each grouped together, providing additional collaborative evidence (FIG. 4B). In addition, this list of genes was compared between patients. Genes that exhibited higher expression in the haired scalp also exhibited a uniform direction of slope among all patients (FIG. 4C, left panel). Similarly, genes higher in the bald scalp exhibited a uniform direction of slope among all patients (FIG. 4C, right panel). Thus, the most statistically significant genes exhibited very uniform behavior across all subjects, further corroborating the gene expression data.

In order to characterize in a non-biased fashion the global expression patterns of genes that were higher in either the donor or recipient, the functional categories of each of the 251 most significantly different genes was determined based on Gene Ontology (GO) classifications (Gene Ontology: The tool for unification of biology. The Gene Ontology Consortium (2000) Nature Genet. 25: 25-29). The 251 most significant genes were subdivided into 2 gene lists: those which were enriched in the haired scalp (169), and those enriched in the bald scalp (81). Each gene list was then analyzed for any common gene functional GO categories within the list using a computerized algorithm. P values were assigned based on the significance of overlapping common categories. Only categories populated by 5 probe sets were considered in the analysis. 13 common categories were found for the genes higher in the donor scalp, and 8 for the bald scalp (FIG. 4D). The 4 most populated gene function categories were development, morphogenesis, organ development and organogenesis, with p values ranging from $1.99 \times 10^{-10}$ to $4.72 \times 10^{-12}$. In addition to multiple known genes, genes not known to be expressed in HF were discovered.

Thus, findings of the present invention reveal genes that participate in hair growth, healthy HF maintenance and cycling, and hair loss.

Example 4: Novel HF Genes Identified by Analysis of Gene Expression

Next, the fold change magnitude and significance of specific gene changes between haired and bald scalp were characterized. The geometric means from the 5 subjects of the abundance of each transcript were expressed as a fold-change, with a positive value indicating enrichment in the haired scalp, and a negative value indicating enrichment in bald scalp.

Consistent with a lack of gross changes in the cell numbers of the bulge stem cell compartment, no significant differences were observed between the expression of KRT15 and FST (FIG. 5A).

To determine the contribution of UV light to the genetic signature of bald scalp, expression of genes known to be affected by UV light was measured. Collagen message was significantly increased (Col11A1 p=0.0038, Col3A1 p=0.0046, arguing against a role of UV light. Expression of PCNA (p=0.917), CDK4 (p=0.797), and cyclin G (p=0.257), which are induced by UV light, was not significantly changed (FIG. 5A). UV light exposure would also be expected to result in fewer T cells and Langerhans cells. To the contrary, however, evidence of more immune cellular infiltration was detected in the bald scalp. Thus, UV light does not fully explain the genetic signature in the bald scalp.

To test the role of steroid metabolism in aging, the expression of genes involved in steroid metabolism was examined. The androgen receptor (AR) and the enzyme 3-beta-HSD were more abundant in the bald scalp (p<0.05; FIG. 5A), thus corroborating the findings of the present invention.

Immune-related gene expression in bald vs. haired scalp was also examined. Multiple MHC genes, both class I and II, were enriched in the bald scalp (FIGS. 3 and 5A). In addition, transcripts specific for T cells, Langerhans cells and mast cells were enriched in a statistically significant manner in the bald scalp (CD4 [p=0.017], Cd1a [p=0.0087], FCER1A [p=0.046] (FIG. 5A). Several genes not known to be expressed in human HF are depicted in FIG. 5B. These genes also exhibited a high degree of statistical significance (minimum p value=0.001) and minimum fold-enrichment in haired scalp of 4.5.

Example 5: In Situ and Immuno-Histological Characterization of Novel HF Genes

In situ hybridization and immuno-histochemistry was next used to determine tissue patterns of expression of significantly enriched transcripts in the haired scalp, using human haired scalp samples from different patients than those used to generate the array and flow cytometry data.

Microarray showed that LRRC15 was upregulated 4.5 fold in the haired samples (FIG. 5B). LRRC15 is a transmembrane glycoprotein with leucine-rich repeats. To determine whether LRRC15 functions in cell migration, LRRC15 expression was measured in scalp samples by immuno-histochemistry. LRRC15 was present in Huxley's layer and the cuticle layer of the inner root sheath, especially at the lower follicle (FIG. 6A), which is an area of rapid cell movement during hair growth. Thus, LRRC15 functions in cell migration necessary for hair growth.

Serpin A was up-regulated 5.7 fold in the haired samples. Serpin A is, in another embodiment, a clade A anti-protease in the same family as anti-trypsin and anti-chymotrypsin. Serpin A was expressed in the companion layer of the outer root sheath, as shown by immuno-histochemistry (FIG. 6B).

Figure 6:
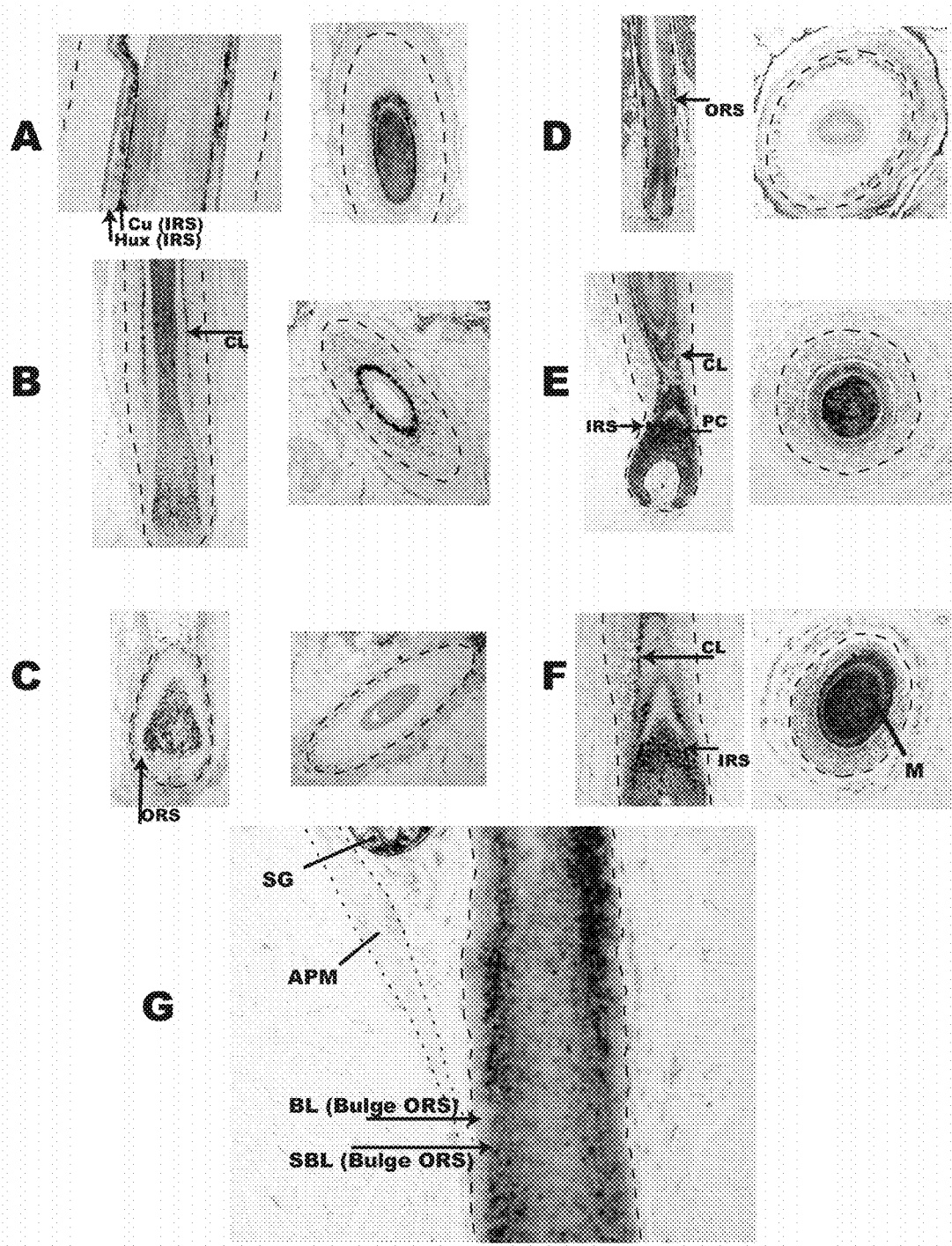
FIG. 6. In situ hybridization showing expression of genes not previously described in human HF and shown herein to be enriched in haired scalp. Left: transverse section; right: horizontal or oblique section. A) LRRC15 is present in Huxley's layer and the cuticle layer of the inner root sheath (IRS). B) Serpin A is expressed in the companion layer (CL). C) GPR49 (LGF5, HG38) is expressed in the outer root sheath (ORS). D) CDT6 is expressed in the ORS. E) GPRC5D is expressed in the IRS and precortical (PC) area of the hair. F-G) FGF18 is expressed in the IRS, CL, matrix (M), and suprabasal cells of the bulge region in the isthmus between the arrector pili muscle (apm) and sebaceous gland (sg).

GPR49 (LGF5, HG38), another leucine rich repeat-containing protein, was upregulated 6.8 fold in the haired samples, and was expressed in human outer root sheath cells, as shown by immuno-histochemistry (FIG. 6C). GPR49 is known to be upregulated in the mouse bulge (outer root sheath), thus further confirming results of the present invention. Enrichment of this G-protein in anagen/terminal follicles show its utility as a drug target for stimulating hair growth.

The Angiopoietin-like gene CDT6 (upregulated 18 fold in the haired samples) is an anti-vascular factor that is also expressed in the cornea (Corneal Derived Transcript 6), and thought to maintain the avascularity of the cornea. CDT6 was expressed in the outer root sheath, as shown by immuno-histochemistry (FIG. 6D), which is also avascular.

GPRC5D (upregulated 19.5 fold in haired samples) is a homologue of RAIG-1 (retinoic acid inducible gene-1). GPRC5D was expressed in the inner root sheath and pre-cortical cells of the hair, as shown by immuno-histochemistry (FIG. 6E).

FGF18 (upregulated almost 6 fold in the haired samples; FIG. 5B) was found to be expressed in the inner root sheath, the companion layer, and to a lesser extent in the suprabasal outer root sheath of the bulge area (FIG. 6F-G).

The genes identified in this Example are all enriched in haired scalp, and are thus therapeutic targets for stimulating hair growth.

Example 6: PGD2S Levels are Elevated in Bald Scalp Materials and Experimental Methods Prostaglandin D2 Measurements in Human Scalp Human scalp was obtained from hair transplants to use in PGD2 measurements. Haired samples were taken from donor sites of hair-bearing scalp from the occiput. Bald samples were taken from recipient tissue taken in the bald frontal scalp to create areas of placement for donor grafts. Immediately post surgery samples were placed at 4 degrees Celsius. Sample weights varied from 0.14-0.94 g. and all results were normalized to starting tissue weight. Within 1-2 days, samples were frozen in liquid nitrogen, and frozen at −70 degrees Celsius for at least 24 hours. After thawing, samples were diluted in 1 ml of acetone and homogenized using a table-top PowerGen 700 Fisher mechanical tissue grinder for 30 seconds at setting 3. Samples were vortexed, centrifuged at 5000×g for 10 minutes, with retention of the supernatant and subsequent second extraction performed on the pellet. Combined supernatants were dried in a speed-vac centrifuge, resuspended in 100 microliter (mcL) of EIA buffer, and PGD2 concentration was determined relative to a prepared standard curve using the Cayman Chemical PGD2-mox ELISA kit. Values were normalized to haired scalp for fold determination.

Results

Figure 7B:
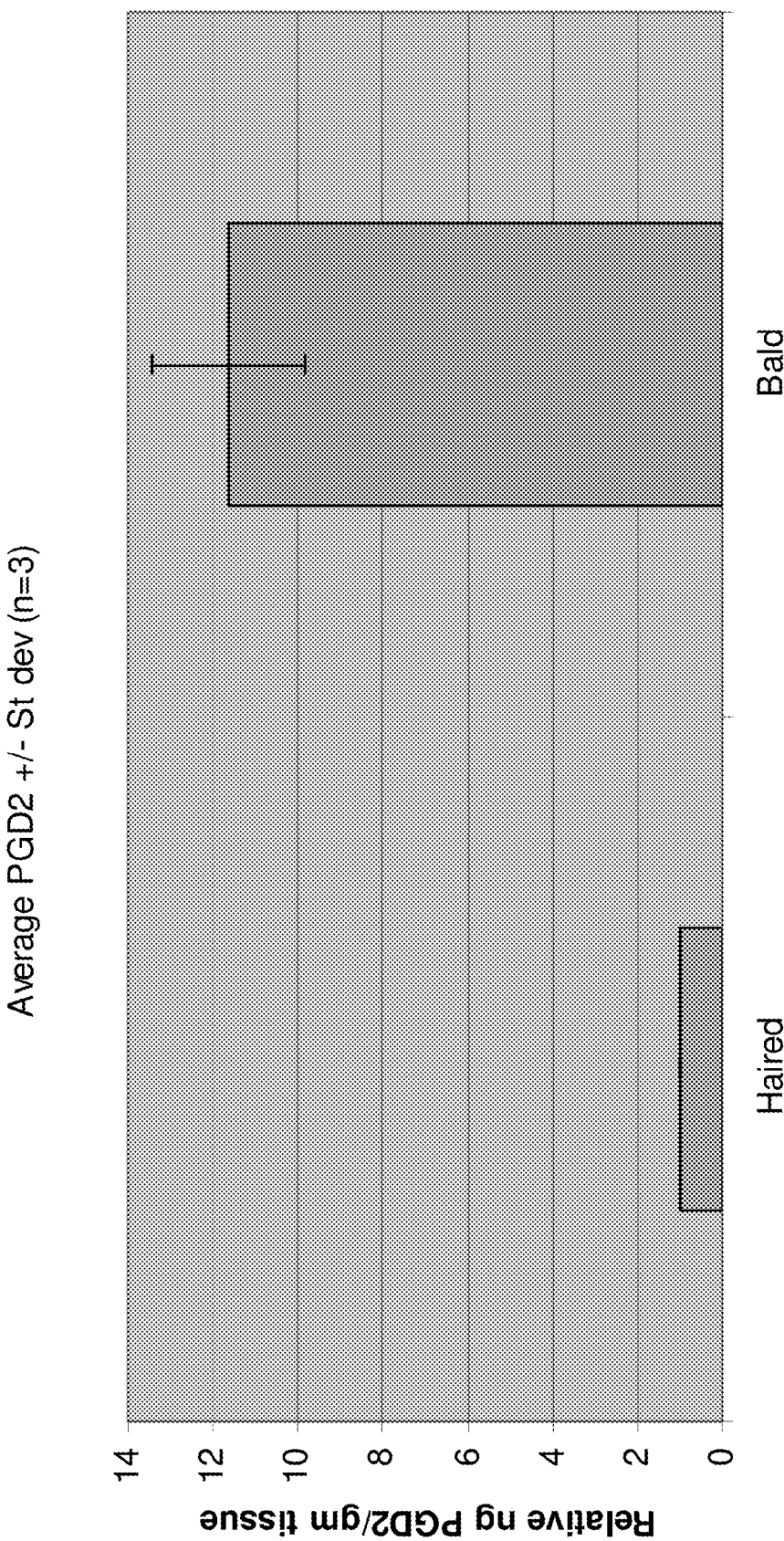
FIG. 7B. PGD2 is elevated in all bald scalp.
Figure 7C:
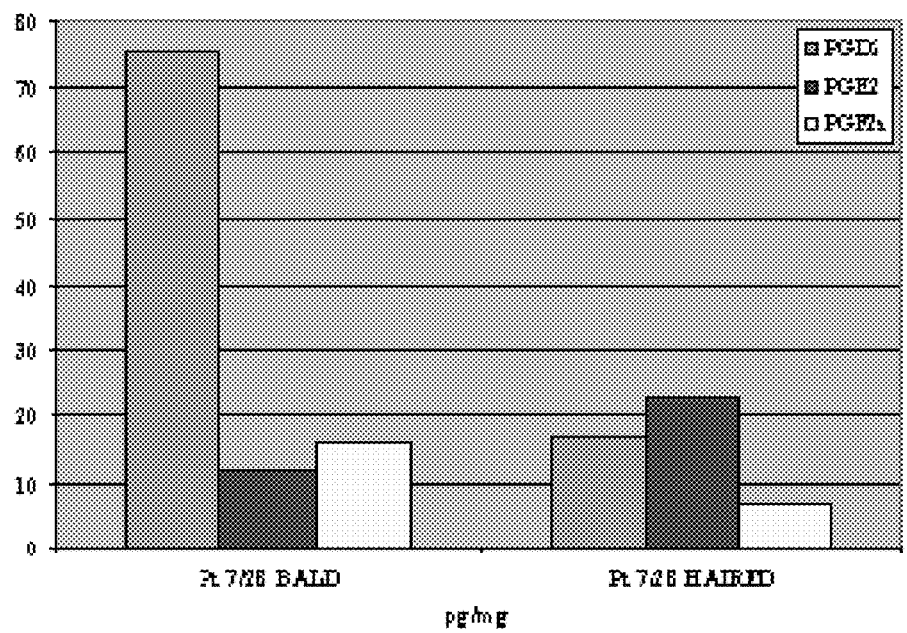
FIG. 7C. Mass spectrometry measurements of PGD2, PGE2, and PGF2a (first, second, and third bar, respectively) in haired vs. bald scalp.

In addition to the above genes, levels of the lipocalin (brain) isoform prostaglandin D2 synthase (PGD2S) were elevated in bald scalp relative to haired scalp (FIG. 7A). To confirm this finding, PGD2 levels were tested in bald and haired tissue from 3 patients. PGD2 was elevated in all bald samples, at an average fold increase of 11.6 (FIG. 7B). This increase in PGD2 was verified in 1 individual by mass spectrometry. PGD2 was detected as 17 pg/mg of tissue in haired scalp and 75.5 pg/mg in bald scalp, representing a 4.4 fold increase in bald tissue. PGF2a also was slightly elevated in bald scalp with 6.7 pg/mg in haired scalp and 15.9 pg/mg in bald scalp. PGE2, however, exhibited the reverse trend with PGE2 present at 22.7 pg/mg in the haired scalp and 12.0 pg/mg in the bald scalp (FIG. 7C).

Figure 7D:
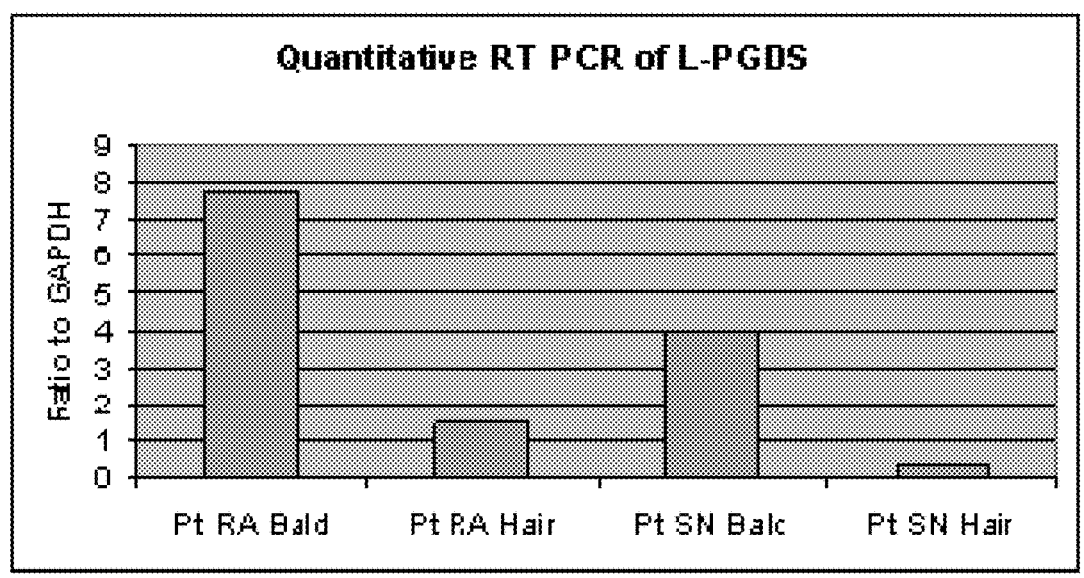
FIG. 7D. Quantitative RT-PCTR of L-PGDS.

The RT-PCR results were further confirmed in 2 individuals not measured in the original array study by quantitative RT PCR, demonstrating a 5.23 and 10.7 fold increase of L-PGDS in bald scalp over haired scalp (FIG. 7D). Immunohistochemical staining of L-PGDS revealed an increase in bald scalp, with L-PGDS appearing in the cells along the fibrous root sheath populated by dermal fibroblasts, as well as in scattered locations intrafollicularly. Given the lack of expression of L-PGDS in hematopoietic cells, increases in L-PGDS were not from the sparse inflammatory cell infiltrate occasionally present in AGA.

Thus, PGD2 synthase and PGD2 are targets for ameliorating common baldness, e.g. AGA.

Figure 9A:
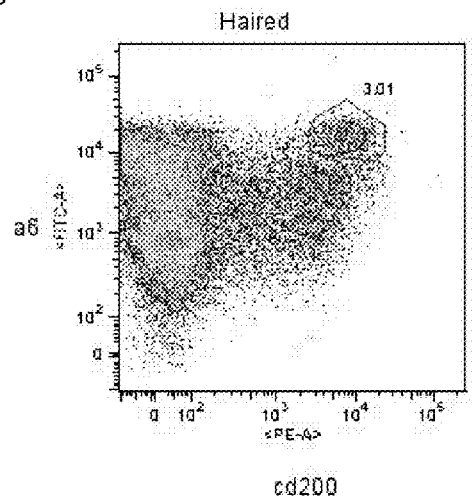
Figure 9B:
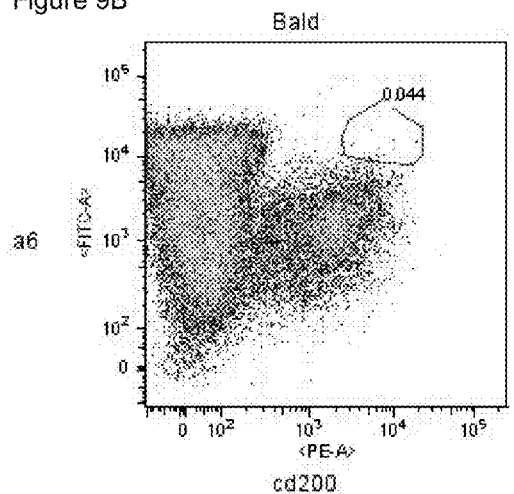
Figure 9C:
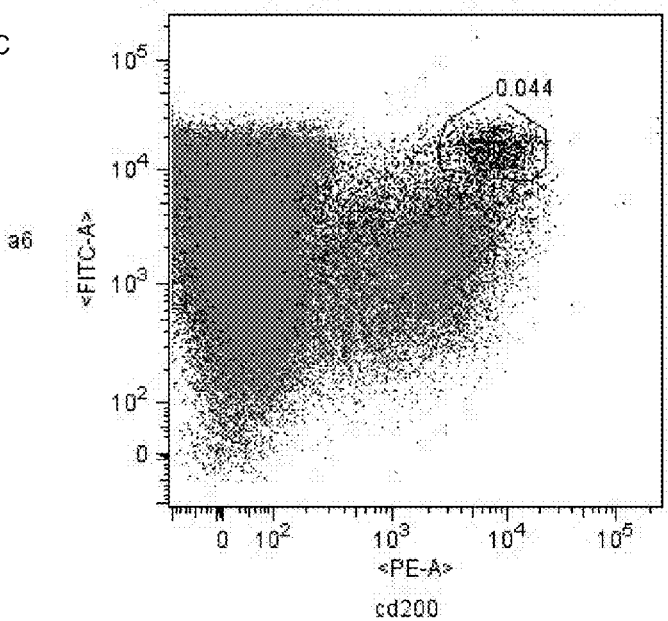

Example 7: Haired Scalp Contains a Population of CD200$^{High}$ Alpha-6 Integrin$^{High}$ Cells that are Lacking in Bald Scalp Haired and bald scalp samples from 5 AGA patients were subjected to staining and FACS for alpha-6 integrin and CD200. In each case, haired and bald samples from the same patient were compared. A population of alpha-6 integrin$^{high}$ CD200$^{high}$ cells was found to be present in the haired but not bald samples (FIG. 9). These findings demonstrate the existence of a stem cell population that can be transplanted to generate new HF and treat baldness. Further, these findings demonstrate that administration of CD200 and analogues thereof can be used to treat baldness.

Example 8: CD200$^{High}$ Alpha-6 Integrin$^{High}$ Cells Possess High In Vitro Proliferative Potential Materials and Experimental Methods Equivalent numbers (5,000 cells/flask) of living alpha-6 integrin$^{high}$ CD200$^{high}$ cells and mid-follicle cells (positive control) are prepared and seeded into T-25 flasks (Corning) onto a lethally irradiated NIH 3T3 cell feeder layer. Hair follicle cells are cultured in a 3:1 mixture of DMEM and Ham's F12 medium (Invitrogen Corp.) supplemented with 10% FBS, 180 μM adenine, 5 μg/ml insulin, 0.5 μg/ml hydrocortisone, 0.1 nM cholera toxin (Sigma-Aldrich), and 10 ng/ml epidermal growth factor (Invitrogen Corp.) for 2 weeks. Colonies are fixed with paraformaldehyde (Electron Microscopy Sciences) and stained with a 1:1 mixture of Rhodamine B and Nile blue sulfate solution (Sigma-Aldrich), and the number of colonies is per flask is counted.

Results

The proliferative potential of alpha-6 integrin$^{high}$ CD200$^{high}$ cells is measured in a colony forming assay. Alpha-6 integrin$^{high}$ CD200$^{high}$ cells are found to exhibit high in vitro proliferative potential, consistent with their role as HF stem cells.

Example 9: CD200$^{High}$ Alpha-6 Integrin$^+$ Cells are Able to Reconstitute HF Materials and Experimental Methods Alpha-6 integrin$^{high}$ CD200$^{high}$ cells expressing a marker protein are isolated by FACS and combined with and equal number of freshly isolated dermal cells from neonatal mice, and injected subcutaneously (sc) (50 mcL of 1×10$^4$ cells per mcl suspension) into CB-17 Icr scid/scid mice. In other experiments, cells are placed in tracheas, then implanted sc into the mice. 4 weeks after implantation, mice are sacrificed, and tracheas or subcutaneous growths are removed and assayed for marker protein activity. As negative controls, dermal cells alone or alpha-6 integrin$^{high}$ CD200$^{high}$ cells alone are injected. In some experiments, ROSA26 reporter mice, which express beta-galactosidase under control of the ROSA26 promoter, are used as the source of the alpha-6 integrin$^{high}$ CD200$^{high}$ cells.

Results

To further characterize the stem cell capacity of alpha-6 integrin$^{high}$ CD200$^{high}$ cells, these cells are engineered to express a reporter protein and transplanted into immunodeficient mice. Alpha-6 integrin$^{high}$ CD200$^{high}$ cells exhibit stem cell proliferative capacity in this assay.

Example 10: Gene Expression Profile of CD200$^{High}$ Alpha-6 Integrin$^{High}$ Cells The gene expression profile of alpha-6 integrin$^{high}$ CD200$^{high}$ cells is determined, as described in Example 3. Genes enriched in the alpha-6 integrin$^{high}$ CD200$^{high}$ cells (e.g. relative to non-bulge basal keratinocytes) play a role in HF formation. Thus, administration of these genes, their protein products, or mimetics and analogues thereof, can be used to stimulate hair growth.

Example 11: PGD2S Levels are Elevated in Skin with Sebaceous Gland Hypertrophy

Sebaceous gland hypertrophy is induced in mice, using a nude mouse grafting model with an altered dermal component, using grafts with an unaltered dermal as a negative control, and PGD2 levels are measured in the both types of skin. PGD2 levels are elevated in the areas of the skin exhibiting sebaceous gland hyperplasia, indicating the role of PGD2 in sebaceous gland hyperplasia, acne, and rosacea.

Example 12: PGD2S Inhibition Ameliorates Sebaceous Gland Hypertrophy

Mice with sebaceous gland hypertrophy are treated with inhibitors of PGD2, and extent of hypertrophy is determined. Sebaceous gland hypertrophy is ameliorated in skin treated with PGD2 inhibitors, but not in untreated areas of the same mice or untreated mice, confirming the role of PGD2 in sebaceous gland hyperplasia, acne, and rosacea.

Example 13: Application of PGD2S Induces Alopecia Materials and Experimental Methods 25 day-old (corresponding to end of the first telogen stage) wild-type c57/black mice were treated with 200 ng of PGD2 (Cayman Chemicals) diluted in 200 μl of acetone applied to the central back after shaving. Subsequent treatments were performed every 3 days, ending on day 40 for a total of 5 applications. Photographs were taken on day 46 of life, after the end of the 2nd anagen. In the second experiment, mice were shaved and treated with 10 μg of PGD2 dissolved in 200 μl of acetone on days 66 and 69 of life, and then photographed on day #121.

Results

Figure 10A:
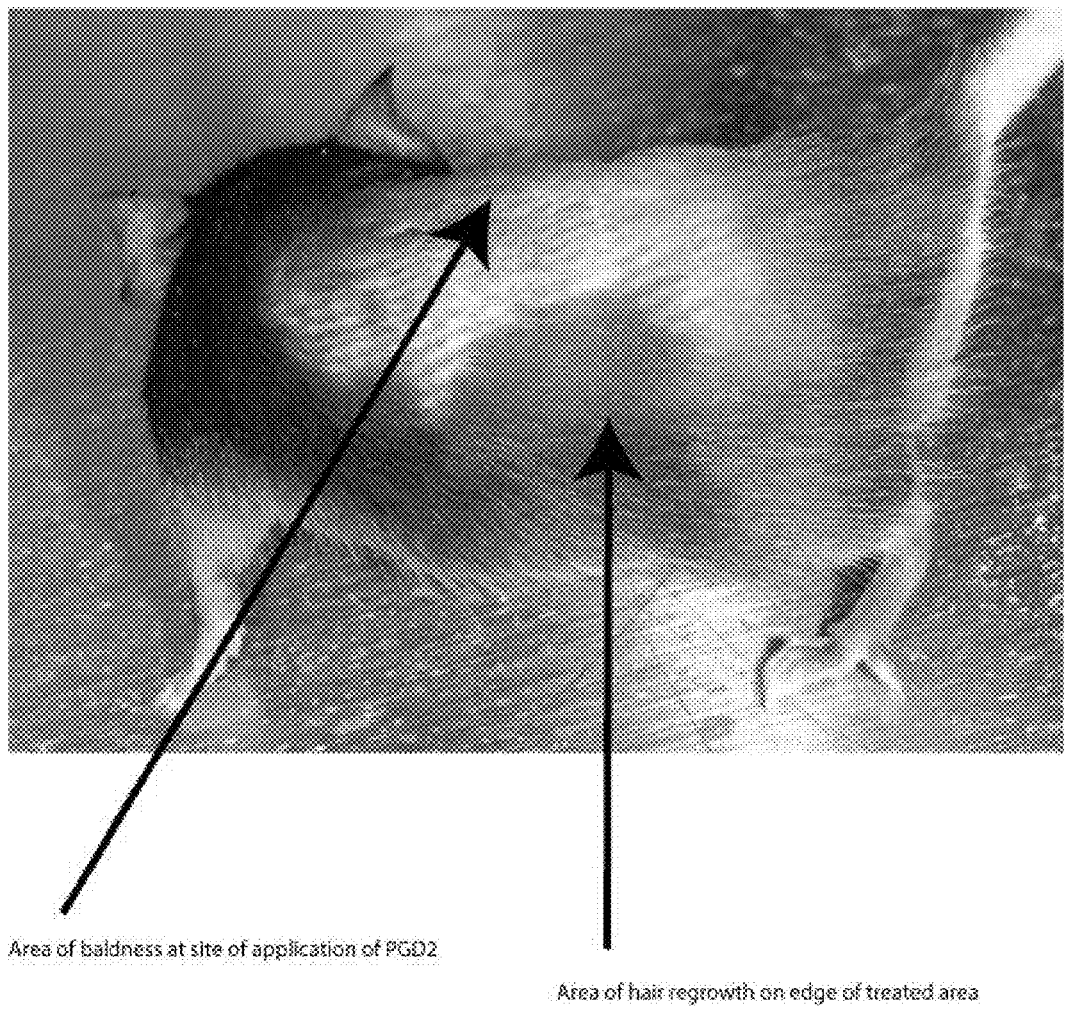
FIG. 10A. 46 day-old mouse exhibiting baldness (alopecia) at the site of PGD2 application on the central back. Note area of hair regrowth at the edge of treated area.
Figure 10B:
FIG. 10B. PGD2-treated and control mice at a 121-day timepoint.

The effect of PGD2 on hair growth was directly determined by applying PGD2 to the backs of mice. Application of PGD2 induced alopecia following the second anagen phase (FIG. 10A). In another experiment, application of PGD2 was shown to prevent hair regrowth over 50 days after the last application (FIG. 10B).

Example 14: K14-COX2 Mice Exhibit PGD2 Elevation and Hair Growth Defects

Figure 11A:
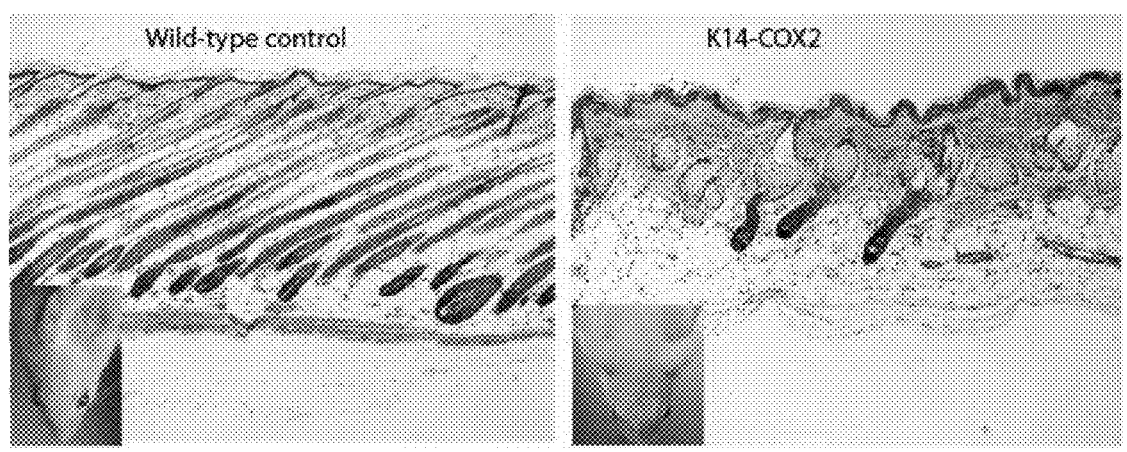
FIGS. 11A-D.

K14-COX2 mice were examined for hair phenotype. The mice exhibited very low gross hair coat volume, without significant change in hair follicle number and anagen percentage of mice at day 29, demonstrating an early defect in hair growth. Sebaceous hyperplasia was also detected at this age. By day 39, sebaceous glands had enlarged further and many hairs were miniaturized (FIG. 11A).

Figure 11B:
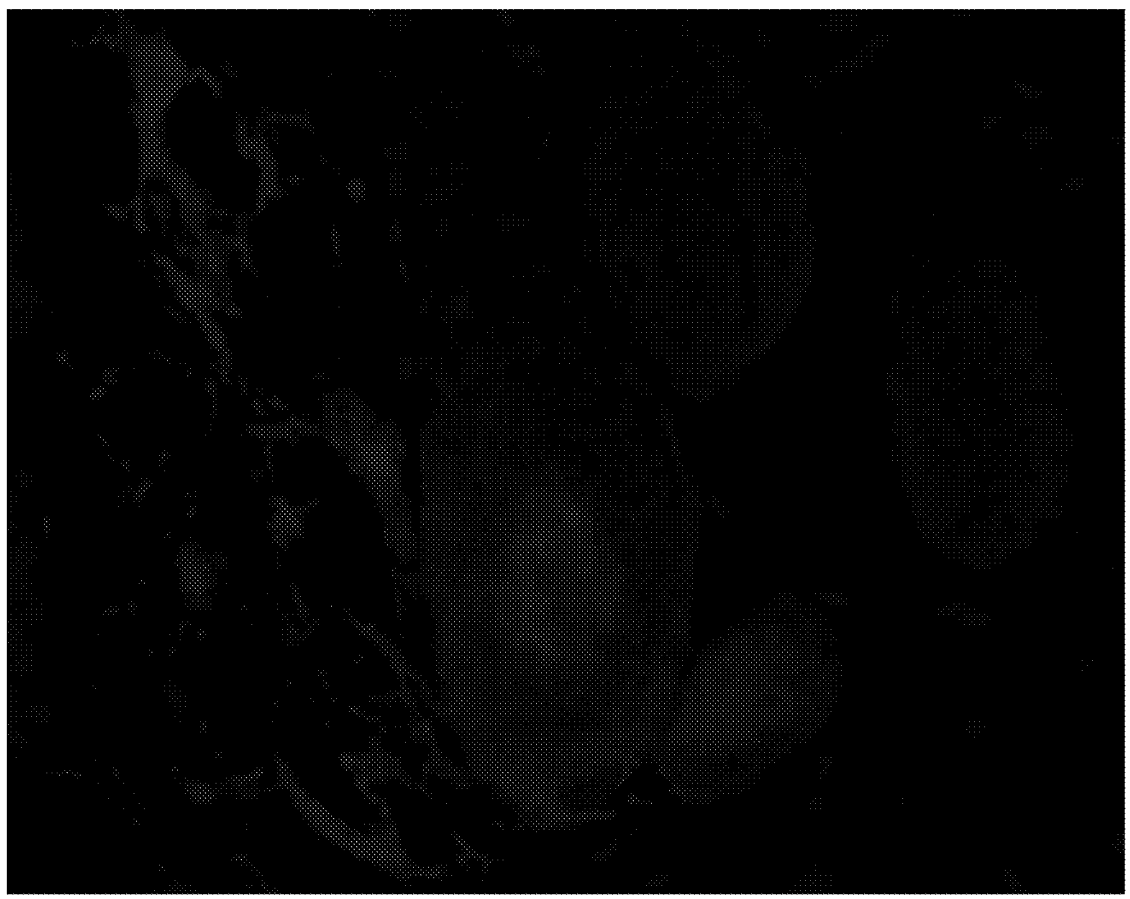
Figure 11C:
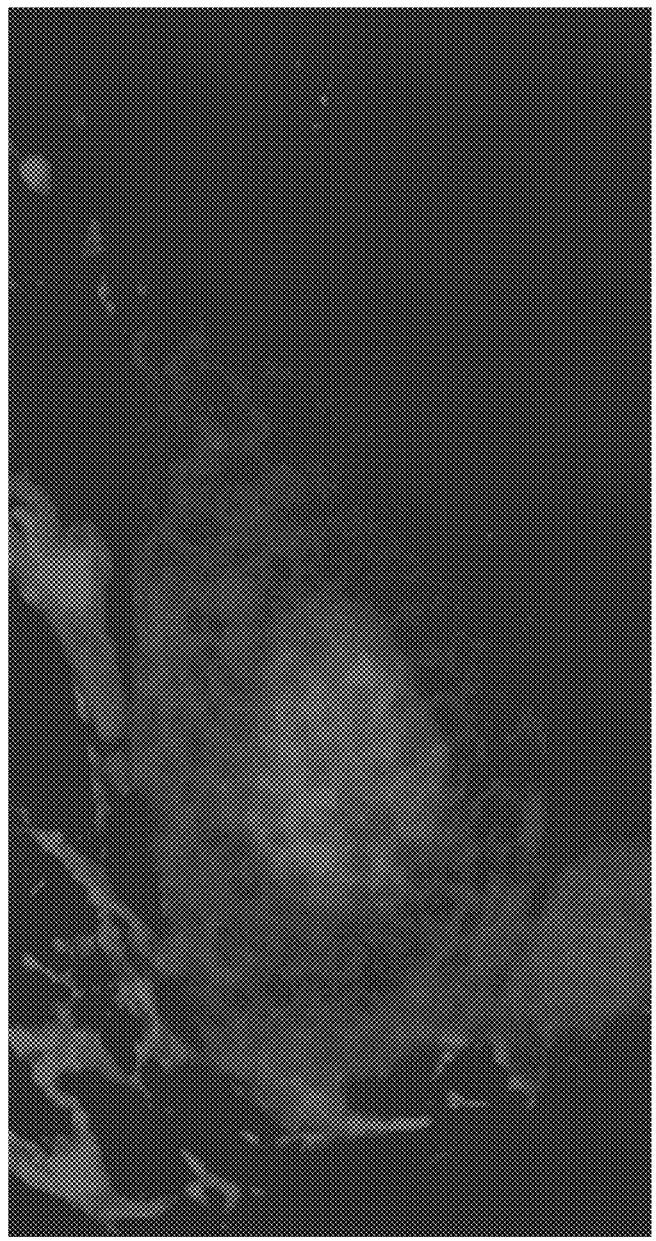
Figure 11D:
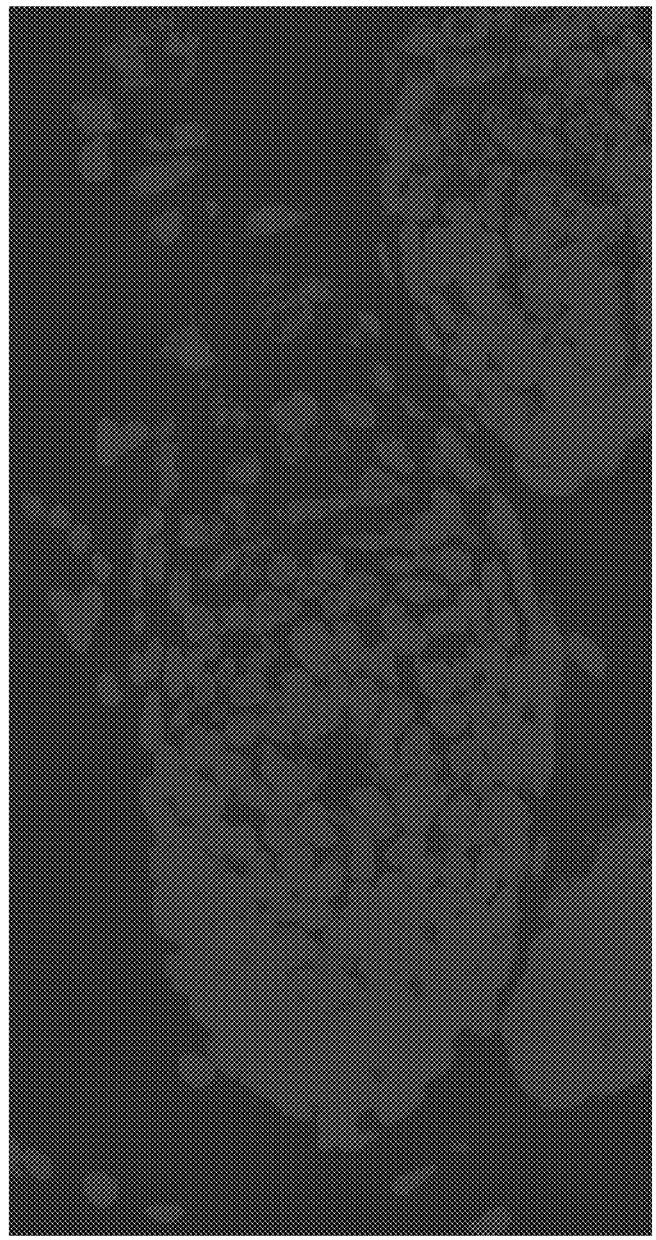

To verify the contribution of L-PGDS to the phenotype of K14-COX2 mice, immunohistochemistry was performed with antibodies against L-PGDS. Adult mice expressed L-PGDS in an infiltrate of dermal cells, hair sheath fibroblasts, and melanocytes. Staining was detected in anagen dermal papilla in wild-type mice (FIG. 11B).

Figure 12:
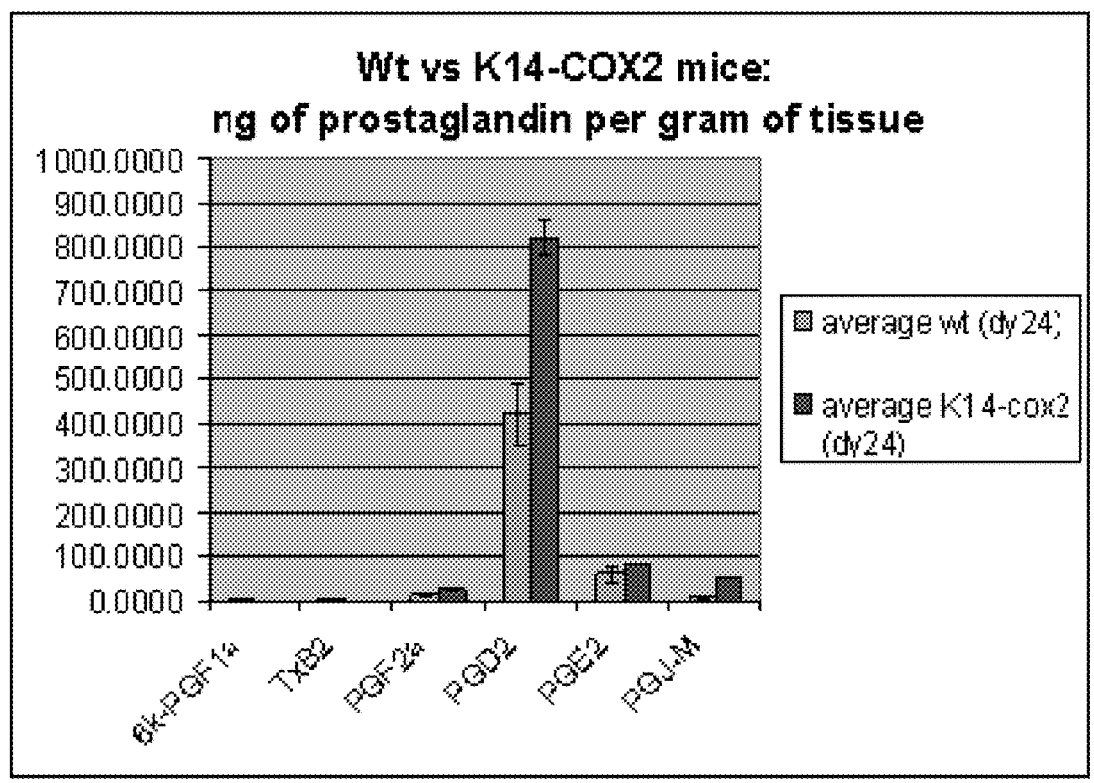
FIG. 12. PGD2 skin levels in normal and K14-COX2 mice.

PGD2 were measured in the K14-COX2 mouse skin via mass spectrometry. PGD2 was 10-fold more abundant than PGE2 in K14-COX2 mice (820.4 ng/gram of tissue vs. 82.4 ng/gram). PGD2 levels were also significantly higher in K14-COX2 mice than in wild type mice in telogen (420.9 ng/gm of tissue, p value=0.01). PGE2 was also elevated, although less so, compared to wild type mice (60.5 ng/gram of tissue). Slight elevations in PGJ-M, a metabolite of PGD2 were also detected (FIG. 12).

These findings corroborate the above androgenetic alopecia findings in humans, by showing that elevations of PGD2 are associated with alopecia and sebaceous gland hyperplasia in mice as well.

Example 15: Identification of Additional Target Genes Regulating Baldness and Hair Loss The data sets from Example 3 were re-analyzed using the following criteria: Genes exhibiting differential expression patterns in bald vs. non-bald scalp (as described in Example 1) were reviewed to identify cell surface proteins, growth factors, cytokines, G-protein coupled receptors and other signaling molecules, and proteins with biological activities possibly related to miniaturization of the hair follicle in baldness. This additional set of genes is depicted in FIG. 13.

SEQUENCE LISTING (323 sequences)

SEQ ID NO: 1 - DNA, 434 bp, Homo sapiens
atgctttctgagagtcatggacttcctgtgcaagaacatgaagcacctgtggtttttcctcctgctggtggcagctccctgatgggtcctgtcccaggtgcagctgcaggagtcgggcccaggactggtgaagccttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagaatccactggctactggggccagggaacctgtcaccgtctcctca

SEQ ID NO: 2 - DNA, 1621 bp, Homo sapiens
caggttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgagcaactgcaactggttctgcgagggctccttcaatggcagcgagaaggagactatgcagttcctgaacgaccgcctggccagctacctggagaaggtgcgtcagctggagcgggacaacgcggagctggagaacctcatccgggagcggtctcagcagcaggagcccttgctgtgccccagctaccagtcctacttcaagaccattgaggagctccagcagaagatcctgtgcagcaagtctgagaatgccaggctggtggtgcagatcgacaatgccaagctggctgcagatgacttcagaaccaagtaccagacggagcagtccctgcggcagctggtggagtccgacatcaacagcctgcgcaggattctggatgagctgaccctgtgcaggtctgacctggaggcccagatggagtccctgaaggaggagctgctgtccctcaagcagaaccatgagcaggaagtcaacaccttgcgctgccagcttggagaccgcctcaacgtggaggtggacgctgctcccgctgtggacctgaaccaggtcctgaacgagaccaggaatcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacagtcaatgccctggagatcgagctgcaggcccagcacaacctgcgatactctctggaaaacacgctgacagagagcgaggcccgctacagctcccagctgtcccaggtgcagagcctgatcaccaacgtggagtcccagctggcggagatccgcagtgacctggagcggcagaaccaggagtatcaggtgctgctggacgtgcgggcgcggctggagtgtgagatcaacacataccggagcctgctggagagcgaggactgcaagctgccctccaacccctgcgccaccaccaatgcatgtgaaaagcccattggatcctgtgtcaccaatccttgtggtcctcgttcccgctgtgggccttgcaacacctttgggtactagataccctggggccagcagaagtatagcatgaagacagaactaccatcggtgggccagttctgcctctctgacaaccatcagccaccggaccccaccccgaggcatcaccacaaatcatggtctggaaggagaacaaatgcccagcgtttgggtctgactctgagcctagggctacttgatcctcctcaccccaggtccctctcctgtagtcagtctgagttctgatggtcagaggttggagctgtgacagtggcatacgaggtgttttgttctctctgctgcttctacctttattgcagttccccaaatcgcctaataaactttcctcttgcaaagcagacaaaaaaaaaaaaaaaaaaaa

SEQ ID NO: 3 - DNA, 953 bp, Homo sapiens
ccatgacccactgttgctccccttgctgtcagcctacctgctgcaggaccacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcaggaccacctgctgccagcccacctgtctgtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatctgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacctatatatttcttaataaataaatttggaactattattcataaaaaaaaaaaaaaaaaa

SEQ ID NO: 4 - DNA, 1713 bp, Homo sapiens
ggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcctacttcaagaccattgaggagctccagcagaagattctgtgtgccaaggctgagaatgccaggctggtggtgaacattgacaatgccaagctggcctctgacgacttcagaagcaagtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggaggttaacaccctgcgctcccagcttggagaccgcctcaacgtggaggtggacactgcccccactgtggacctgaaccaggtcctgaacgagaccaggagtcagtatgaggctctggtggaaattaaccgcagggaagtggagcaatggttcgccacgcagaccgaggagctgaacaagcaggtggtatccagctcagagcagctgcagtcctgccaggcggagatcatcgagctgagacgcacagtcaacgccctggagatcgagctgcaggcccagcacaacctgcgagactctctggaaaacacgctgacggagagcgaggcccactacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggcataa

SEQ ID NO: 5 - DNA, 1252 bp, Homo sapiens
ggactctgtcttcagctggacactccctccctgcaccatgtcttacagttgtggcctgcccagcctgagctgccgcaccagctgctcctcccggccctgtgtgccccccagctgccacggctgcaccctgcccggggcctgcaacatccccgccaatgtgagcaactgcaactggttctgtgagggctccttcaatggcagtgagaaggagaccatgcagttcctgaacgaccgcctggccagctacctggagaaggtgcgtcagctggagcgggacaacgcggagctggagaacctcatccgggagcggtcacagcagcaggagcccttggtgtgtgccagctaccagtcctacttcaagaccattgaggagctccagcagaagatcctgtgcagcaagtctgagaatgccaggcttgtggtgcagatcgacaatgccaagctggcctcagatgacttcaggaccaaatatgagaccgagctgtccctgcggcagctggtggagtcggacatcaatggcctgcgcaggatcctggatgagctgaccctgtgcaggtctgacctggaggcccaggtggagtccctgaaggaggagctgctgtgcctcaagcagaaccatgagcaggaggttaacaccctgcgctgccagcttggagaccgcctcaacgtggaggtggacgctgctcccactgtggacctgaaccaggtcctgaatgagaccaggagtcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacggtcaatgccctggagatcgagctgcaggcccagcacaacctgcgagactctctggaaaacacgctgacagagagcgaggcccgctacagctcccagctgtcccaggtgcagagactgatcaccaacgtggagtcccagctggcggagatccgcagtgacctggagcggcagaaccaggagtatcaggtgctgctggacgtgcgggcgcggctggagtgtgagatcaacacgtaccggagcctgctggagagcgaggactgcaagctcccctccaacccctgcgccacaaccaatgcatgtgacaagtccactgggccctgtatctctaatccctgtggcctacgtgctcggtgtgggccttgcaacacatttgggtactag

SEQ ID NO: 6 - DNA, 903 bp, Homo sapiens
aataggcagccataattcagaaactcctccaagcaacccaaccttcagatcaactcctgacaccatggcctgctgtcagaccagcttctgtggatttcccagctgctccaccagtgggacctgcggctccagctgctgccagccaagctgctgtgagaccagctcctgccagccacgctgctgtgagaccagctgctgccagccaagctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatg

SEQ ID NO: 7 - DNA, 986 bp, Homo sapiens
aagcaacccagacttcataccagctcccaacaccatgacctgctgccagaccagcttctgtggatatcccagctgctccaccagtgggacatgcggctccagctgctgccagccaagctgctgtgagaccagctgctgccagccaagctgctgccagaccagcttctgcggatttcctagcttctcaactagtgggacctgcagctccagttgctgccagccaagctgctgtgagaccagctgctgccagccaagctgctgccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgtgtggtgagctgcacacccccaacctgctgccagctgcaccacgccgaggcctcctgctgccgcccatcctactgtggacagtcctgctgccgcccagtctgctgctgctactcctgtgagcccacctgctaaaagccagtttgctgattttcaacttgaaatttccactttcagttccattcatgaacgaattatttcttcaagcacttatggacaacgaacaaattcttcaacctttctttgtctttcttatgggggttaccaaatattttggcctcagaattatctgattcctttcaattccagaaagaccttactcttctctctgaggacgccaaaatacaaatttgacccaagaaatgaaaaagccgatttaccttgaaactgagcctttgcaagcattgaagcccacgctctgagtctcagcgccgacgagaccatggaagagccatctgtccttctcaggacactcacttcctgtatcccaccgtcctgcaaattgcaccccctatgaaagaggaataatataccaaggtctaataaattttaactattggtgcaacaaaaaaaaaaaaaaaaa

SEQ ID NO: 8 - DNA, 1616 bp, Homo sapiens
gagaatttagactctgtcttcagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgtgagcaactgcaactggttctgcgagggctccttcaatggtagcgagaaggagactatgcagttcctgaacgaccgcctggccagctacctggagaaagtgcgtcagctggagcgggacaacgcggagctggagaacctcatccgggagcggtctcagcagcaggagcccttgctgtgccccagttaccagtcctattttaagaccattgaggagctccagcagaagatcctgtgtaccaagtctgagaatgccaggcttgtggtgcagatcgacaacgccaagctggctgcggatgatttcagaaccaagtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcagaccgaggagctgaacaagcaggtggtatccagctcagagcagctgcagtcctaccaggcggagatcatcgagctgagacgcacagtcaacgccctggagatcgagctgcaggcccagcacaacctgcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaatctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgctcaccctttccttcctgggggtctgttccttcctatgctcacccagagaactctctgatgtgccagtgggcctcccttttaacctcctaataaatatcatttccttggcaaaaaaaaaaaaaaaaaaaaaaa

SEQ ID NO: 9 - DNA, 1038 bp, Homo sapiens
atgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttgtgtctccttctcctggacgacaattctgtgcattgctattggttgcagtctgttgcaaatcattattgccactgagtatgtgactctcatcatgaccagaggtatgatgtttgtgaatatgacaccctgccagctcaatgtggactttgttgtactcctggtctatgtcctcttcctgatggccctcacattcttcgtctccaaagccaccttctgtggcccgtgtgagaactggaagcagcatggaaggctcatctttatcactgtgctcttctccatcatcatctgggtggtgtggatctccatgctcctgagaggcaacccgcagttccagcgacagccccagtgggacgacccggtcgtctgcattgctctggtcaccaacgcatgggttttcctgctgctgtacatcgtccctgagctctgcattctctacagatcgtgtagacaggagtgccctttacaaggcaatgcctgccccgtcacagcctaccaacacagcttccaagtggagaaccaggagctctccagagcccgagacagtgatggagctgaggaggatgtagcattaacttcatatggtactcccattcagccgcagactgttgatcccacacaagagtgtttcatcccacaggctaaactaagcccccagcaagatgcaggaggagtataa

SEQ ID NO: 10 - DNA, 1925 bp, Homo sapiens
actccaggtcccctatcctgtcctctgcaacccaaacgtccaggaggatcatgacctgcggatcaggatttggtgggcgcgccttcagctgcatctcggcctgcgggccgcgccccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatccgcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaatgagctgaaccgcatgatccaaaggctgacggccgaggtggagaatgccaagtgccagaactccaagctggaggccgcggtggctcagtctgagcagcagggtgaggcagccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttgcctgccctgccttgcttggcccagtcagtcaggcgcctggagaagtgctcagctacttctcctgcactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaaaaaaaaaaaaaaaaaa

SEQ ID NO: 11 - DNA, 2046 bp, Homo sapiens
ggatcttactgtggtggccgcgccttcagctgcatctcggcctgtgggccccggcccggccgctgctgcatcaccgctgccccctaccgtggcatctcctgctaccgcggcctcaccgggggcttcggcagccacagcgtgtgcggaggctttcgggccggctcctgcggacgcgacttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcagattcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaggagaacgcgccgcccgcgccggcctcccaatagccgccgcccgctgcctgcactctaagcgctctccccacgtccgctccgggagccatccccggtcgcaggagtccggggagggccgggaggcgccatggtctctctctgtagcctttcctggtagtcaatttgttgtcccgaggattcatctttttcttcctcctaccttctgttttttttttcatgtatgcattggtcttgcctgagctcttcctcaaagcttggaggaacgggggagggcccgggaatgtccctgtctgcacgacctgggactctgcccatgtgcttttgcctgtggaatggagacgcggaccctggatagtggttctatgactctgcgagggacaggcccacgcgtgtggggagaacatctccttccggggctgccctcaagagcttctgaaaaactaatgactctgctgccttctcctttgtctttgtttcactctgtgtttccaataaactcattgtagcgaatcaaaaaaaaaaaaaaaaaa

SEQ ID NO: 12 - DNA, 2255 bp, Homo sapiens
cttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtgaaaaaaaaaaaaaaaaaa

SEQ ID NO: 13 - DNA, 402 bp, Homo sapiens
atgaaaccccagtttgttgggatcttgctcagctccctgctaggggctgccttgggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 14 - DNA, 1203 bp, Homo sapiens
cttcactctcttgaaaacccacccagatcctccccgttctgacaccatggtcagctcctgttgtggctccgtgtgctctgaccagggctgcggccaagtcctctgtcaggagacctgctgccgccccagctgctgtcagaccacctgttgcaggaccacctgctaccgccccagctgttgtgtgtccagctgctgcaggccccagtgctgccagtctgtgtgctgccaacccacctgctgtcgccccagctgctgtgagacgacctgctgccaccctaggtgctgcatctccagctgctgccgccccagctgctgtatgtccagctgctgcaagccccagtgctgccagtctgtgtgctgccagcccacctgctgccaccccagctgctgcatctccagctgctgtcgccccagctgctgtgtgtccaggtgctgcaggccccagtgctgccagtctgtgtgctgccagccaacctgctgccgtcccagctgctgcatctccagctgctgccgcccctcttgctgtgaatccagctgctgccgcccatgctgctgccgcccctgctgctgcctgcgtccagtctgtggccgagtctcctgccacaccacttgctatcgcccaacctgtgtcatctccacctgtccccgccccttgtgctgtgcctcctcttgctgctgagcccactgccctggctcacgtcccccttcaccactggcccacagatgtagacccttctactgtgctgaccattaggatacatgaagtggggttgatgtcattcaataggatggaccttatgcttccaaagagcccaccaccatttcactgactctgtgagaacattctggttcattttaaactccctcccttgctttctttttcttctggtggtggcaccaaatgtgaattaatttgtaatacactagctaagaaattattccaatcttctgatttccttattttctttatcactttaaggtacagattctccttctcagtgaggtagatattatctgcaggaccagttttgtcactgatgttgcaccctcagatccagccacccaattgtattctgtgtttctcctagggtgaatttcttatgctttgtttgcatctctgctttctaataaacttttctgcacttaagaaaaaaaaaaaaaaaaaaaaaaaaaaaaaaaaaaaaaaaaaaaaaaaaaaaaaaa

SEQ ID NO: 15 - DNA, 1687 bp, Homo sapiens
ctggcctcagagacctatcaattgcatctgagttgcaggggccatggcttccaaatgcctcaaggccggcttctcttctgggtctctcaagagcccaggaggggccagtgggggctccactcgtgtgtccgcaatgtactccagcagcccttgcaagcttccaagtctctcccctgtggccagaagtttctctgcctgctcagtgggtctgggcagaagcagctacagggccaccagctgcctccctgctctctgcctccctgctggaggcttcgctaccagctacagtgggggtgggggctggtttggggagggcatcctcactggcaatgagaaggagaccatgcaatccctgaacgaccgcctggccggctacctggagaaggtgcgtcacgtggagcaggagaacgccagcctggagagccgcatccgtgagtggtgtgagcagcaggtcccctacatgtgccctgactaccagtcctacttccggaccatcgaggagctccagaagaagactctatgcagcaaggctgagaatgccaggctggtggtggagattgacaatgccaaattggctgcagatgacttcaggaccaagtatgagacggaggtgtccctgcggcagctggtggagtcagacatcaacggcctgcgcaggatcctggatgacctgaccctgtgcaagtctgacctggaggcccaggtggagtccctgaaggaggagctgctctgcctgaagaagaaccatgaggaggaagtgaactcactgcgctgccaacttggtgaccgcctcaatgttgaggtggatgctgccccacctgttgacctgaaccgagttctggaggagatgaggtgccagtatgaaaccctggtggagaataaccgccgggatgctgaagactggttggacacccagagtgaggagctgaaccagcaggtggtgtccagctcagagcagttgcagtcctgccaggcagagatcatcgagctgagacgcacggtcaacgccctggagattgagctgcaggcccagcacagcatgagagatgctttggaatccaccctggcagagacggaggcccgctatagctcccagctggcccagatgcagtgcatgatcaccaacgtggaggcccagctggccgagatccgggctgacctggagcggcagaaccaggagtaccaggtgctgctggacgtccgggcccggctggagtgtgagatcaacacgtaccggggcctgctggagagtgaggacagcaagctcccctgtaacccatgtgcacctgactactcaccctccaagtcatgccttccctgtcttcctgcggcctcctgcggtcctagtgcagcccgcacaaactgcagcgcccgccccatttgtgtgccctgcccagggggccggttctgagagcgggtctggctgaaaaggctttctgcaaatacatgccctaaagtttctcagagcctgtcacaaaggccggctgcccccaaaggtctcaactcctcatcatttcaatgggtgccagggtctctgttctcaggctgcctcctgggtcaggttttccttctaggtgctgttccggtggattctgaaatgcagtagagggcttttgttggcagaacaataaagtgcatttgctcaggcccctgatgcctaacttgcaccaaaaaaaaaaaaaaaaaa

SEQ ID NO: 16 - DNA, 1883 bp, Homo sapiens
gttccatcctctgccatctactccactgttcagacacctcctaacctccgtcatgacctgtggcttcaactccataggctgtgggttccgccctggaaacttcagctgtgtctctgcctgcgggccccggccaagccgctgctgcatcaccgccgccccctaccgcggcatctcctgctaccgcggcctcaccgggggctttggcagccacagcgtgtgcgggggcttccgcgccggctcctgcggacgcagcttcggctaccgctccgggggcgtgtgcggacccagccccccatgcatcaccaccgtgtcggtcaacgagagcctcctcacgcccctcaacctggagatagaccccaacgcgcagtgcgtgaagcaggaggagaaggagcagatcaagtccctcaacagcagattcgcggccttcatcgacaaggtgcgcttcctggagcagcagaacaagctgctggagacaaagctgcagttctaccaaaactgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtatgaagaagaagtagcacttcgagccacagcagagaacgagtttgtggctctaaagaaggatgtggactgtgcctacctccgcaagtcagacctggaggccaacgtggaggccctgatccaggagattgacttcctgaggcggctgtacgaggaggagatccgcattctccaatcccacatctcagacacctccgtggttgtcaagctggacaacagccgggacctgaacatggactgcatcgttgccgagatcaaggcacagtatgatgacattgccacccgtagccgggctgaggccgagtcctggtatcgcagcaagtgtgaggagatgaaggccacagtgatcaggcacggggagaccctgcgccgcaccaaggaggagatcaacgagctgaaccgcatgatccagaggctgacagccgaggtggagaatgccaagtgccagaactccaagctggaagctgcggtggcccagtctgagcagcagggtgaggcggccctcagtgatgcccgctgcaagctggccgagctggagggcgccctgcagaaggccaagcaagacatggcctgcctgatcagggagtaccaggaggtgatgaactccaagctaggcctggatatcgagatcgccacctacaggcgcctgctggagggcgaggagcagaggctgtgtgaaggtgttgaagctgtgaatgtctgtgtcagcagctcccggggtggggttgtgtgcggggacctctgcgtgtcgggctcccggccggtgacgggcagcgtctgcagtgccccctgcaacgggaacctggtggtgagcactggtttgtgcaagccctgtggccagctgaacaccacctgtggagggggctcctgcggccaggggaggtattaagtggcccaaaagagagccaggggagccccttctgcctgccagacgtgccactgccccaccaccagctgaaaacagcagcacatcgctggcttttccccttgtgttctgagaatacaccatcggctcattcccaccagtggctcctccccacctttcatcccactggaaaggggtctgtggctggggaatagacccattccttcccctgtctcagccttcagcccctcccggggagaagggccttgcttccctggaagaagcactgtgagactgttccccctgcctctctggcctcttgtctccccttttccaataaacttgggacctgcaaaaaaaaaaaaaaaaaaaa

SEQ ID NO: 17 - DNA, 738 bp, Homo sapiens
agtctcagattggtaaacacccgaactggtcaactctcaagagaccatctggttcaggttcctgactgggccagcgagtgaggatggccaggcctctggagcaggcggtagctgccatcgtgtgcaccttccaggaatacgcagggcgctgtggggacaaatacaagctctgccaggcggagctcaaggagctgctgcagaaggagctggccacctggaccccgactgagtttcgggaatgtgactacaacaaattcatgagtgttctggacaccaacaaggactgcgaggtggactttgtggagtatgtgcgctcacttgcctgcctctgtctctactgccacgagtacttcaaggactgcccctcagagcccccctgctcccagtagcctctgctccagggggtgcgctggctgtcgggggctgggcatgtctcccacaccccctcctaccctctctcctgtacccctttcaatctggacttgcccaggtcttctgcgatcagttaacccattttacctaggaggcccagagatgtgagggctccttcctcaggatgcccagcgaatgaggggtagagccactctggggcccagcctgcctgccgcacccctgtggcctcccttgtggatgggaggaggcgggatctgctctgaggccctcgaggctcagcagagcgtgcaccaatgagaccacgatgggaaagggcctatttaactcctaataaaaaactggcat

SEQ ID NO: 18 - DNA, 2471 bp, Homo sapiens
agaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcagggaaaaaaaaaaaaaaaaaaaa

SEQ ID NO: 19 - DNA, 2491 bp, Homo sapiens
agctctccccaccaataaaaggaccagggaggatcagagagagcagaaggatcctgagcctcgcactctgccgcccgcaccaccttccgctgcctctcagactctgctcagcctcacacgatgtcgtgccgctcctacaggatcagctcaggatgcggggtcaccaggaacttcagctcctgctcagctgtggcccccaaaactggcaaccgctgctgcatcagcgccgccccctaccgaggggtgtcctgctaccgagggctgacgggcttcggcagccgcagcctctgcaacctgggctcctgcgggccccggatagctgtaggtggcttccgagccggctcctgcggacgcagcttcggctaccgctccgggggcgtgtgcggacccagccccccatgcatcactaccgtgtcggtcaacgagagcctcctcacgcccctcaacctggagatcgaccccaacgcacagtgcgtgaagcaggaggagaaggagcagatcaagtccctcaacagcaggttcgcggccttcatcgacaaggtgcgcttcctggagcagcagaacaagctgctggagaccaagtggcagttctaccagaaccagcgctgctgcgagagcaacctggagccactgttcagtggctacatcgagactctgcggcgggaggccgagtgcgtggaggccgacagcgggaggctggcctcagagctcaaccatgtgcaggaggtgctggagggctacaagaagaagtatgaagaggaggtggccctgagagccacagcagagaatgagtttgtcgttctaaagaaggacgtggactgtgcctacctgcggaaatcagacctggaggccaatgtggaggccctggtggaggagtctagcttcctgaggcgcctctatgaagaggagatccgcgttctccaagcccacatctcagacacctcggtcatagtcaagatggacaacagccgagacctgaacatggactgcatcatcgctgagatcaaggctcagtatgacgatgttgccagccgcagccgggccgaggctgagtcctggtaccgtagcaagtgtgaggagatgaaggccacggtgatcaggcatggggagaccctgcgccgcaccaaggaggagatcaacgagctgaaccgcatgatccagaggctgacggccgagattgagaatgccaagtgccagcgtgccaagctggaggctgctgtggctgaggcagagcagcagggtgaggcggccctcagcgatgcccgctgcaagctggctgagctggagggcgccctgcagaaggccaagcaggacatggcctgcctgctcaaggagtaccaggaggtgatgaactccaagctgggcctggacatcgagatcgccacctacaggcgcctgctggagggcgaggaacacaggctgtgtgaaggtgtgggctctgtgaatgtctgtgtcagcagctcccgtggtggagtctcctgtgggggcctctcctacagcaccaccccagggcgccagatcacttctggcccctcagccataggcggcagcatcacggtggtggcccctgactcctgtgccccctgccagcctcgttcctccagcttcagctgcgggagtagccggtcggtccgctttgcctagtagagtcatggagccagggcttcctgccaagcacctgcctgcctgcatcactgcactgaatggcatgtgaatggaaaatgtgtgcttgcttccagaatcttctggatgttcctacagagggaaagacctacagagggaaagaccctcgggccgctcccctgcgccttttcatgctagggagatgcatcctagttgtcctcctggcagctgttttcagaggcattcccagcccttcacttaactcctacttagctccaaaatacctgtatccaatttgtattattcccccagctctcagggacaagaccagtcccccagcgtggtggtcagcacggaagctccaccttctgggtggaggcgccatcctaaccatccagccaggccacccacaacccgagaatcagggagaaagtccctccccagcagccccctcctcctggctgggaagaatggtcccccagcaagcacttgcctgttcattcctgttcatgttttgcttctctctcagactgccttcctgcttctgggctaacctgttccagccaggctcctcatgtgacctcgcagttgagaagcccattatcgtggggcatccttttgcctacagcccctggttagggcactttggacaggtcttgctattcagtgaacctttgtacatttcaaagaagactccatggctgctccagatgcccccttgctgggtgcaggtggggactgtccaatgcagagctggcgggacagagagttaagccacttcctgggtctccttcttgtgactgtctatgggtgcattgccttctgggttgtctcgatctgtgtttcaataaatgccgctgcaatgcaa

SEQ ID NO: 20 - DNA, 2005 bp, Homo sapiens
ggcggcatggggtctgtagacatccaggtagctgtggctgaggagaaagggcctctccaacatgacatcctcctgctgtgtcaccaacaacttgcaagcctctctcaagagctgcccccggcctgcctcggtctgttccagcggcgtgaactgccggcctgagctgtgcctgggctatgtctgccagcccatggcatgcctgccttcggtctgcctgcccaccaccttccggccagccagctgcctctccaaaacctatctatccagttcctgccaggcagccagtggcatctccggctccatgggccccggcagctggtacagcgaaggggccttcaatggcaatgagaaggaaaccatgcagttccttaacgaccgcctggccagctacctgacgagggtgcggcagctggagcaggagaatgcggagctggagagcaggatccaagaggcctctcactcccaggtgctcaccatgactcctgactaccagtctcatttcaggaccattgaggagctccagcagaagattctgtgtaccaaggcagagaatgccaggatggttgtgaacattgataatgccaaactggctgccgatgacttcagggccaagtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcagatggaggagcttaaccaacaggtggccacaagctctgagcagcttcagaactaccagtcagacatcattgacctgagacgcacggtcaacacgctggagatcgagctgcaggcccagcacagcctgagggactccctggaaaacacgctgacggagagtgaggcccgctacagctcccagctggcccagatgcagtgcatgatcaccaacgttgaggcccagctggctgagatccgggctgacctggagcggcagaaccaggagtaccaggtgctgctggacgtccgggcccggctggagggcgagatcaacacgtaccggagcctgctggagaacgaggactgcaagctgccctgtaacccatgctccactccttcctgcaccacctgtgtgccctccccatgcgtgccccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaacatgtctgtctctgtttgtcacttacgctgctgcatccacaagccaatcctactcaattgggcttaagaggaacgtgggcaaattctgtatttatttttatgctccttctgcttccatagaggcttgagaggtgttcactaaaagggcccgcatgccataaaccagttaaaactaatcaattactctagagccaagtaataaaagaataaagagaggagggagataattatgccagaaacctaggccaaattactgtaattgagaatcatatcataataaacccacccctaaatctca

SEQ ID NO: 21 - DNA, 1143 bp, Homo sapiens
gagatgccaagtgggtattgactgctccaggatgtggatggagggtgtgaaaaccagggtggggtgacgcaggctctgggtcatgatagggagagcaggcagctgggtcctgggctggaggactaaaataagggacgccaccttcaggggtgacacatcagcccaggccctccctacgggtttgaccagtcctgttctgacggtattcctgcgccactgggctggtccctcctccactcctcccctataaagcctcctggggtccccaggcacccagactcagcccaccccagctttgggggccagtacgcagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctacggtactgtgttcccttctgccacctggtggccggcggcaggaactatcagtagacagctgctgcttccatgaaacggaaaaataaaaatcatgttttcttaa

SEQ ID NO: 22 - protein, 1030 aa, Homo sapiens
TTATWAHAAATTTATTTTTAACCCAATAGAAAAGCAAATTTGGAATCTATTTACAAGTACTATATATTTACATATATACAGTTAGAGTGGGAGATTTAAAGAAAATGGGCAGAGAAACACAATATAAATCAAAGAATATGCCACTGTACAAGGCATTATTATCATTATCATGGTCCTTAATGTTACTGAACCTTTACTATAGTAATAAATACAGTTCTATATTTACACATCTTATAAAACATCTCATAAATGTATTTTTTCAAATCCAAGTHAAAACATCTGATCAAAATAAACATGCTTATATAAAAATAAATCTACCTAACAGCCATTTGGTTTGGATGTATTGARGCTAATATAGGATAATAGAGGGTAAGRBTTAATACTTTGACTTTTCTTATTTAATAACTTGCTTCTTAAAATACCTAACACAGTATTAATATGGAATARGCRGAGARGTAATGTTCCTAACATCAAGTGGGTTATCCAGAGAGAACACAGCTAAAACCAAGCTAAATAAACAGGATAATACGTTACTGAGTCTCTTGAGTCCAAAGTGGTGTCAGATATTGGGTTTGCCAGAGCTACTAGAGATACATGTGTGAGAGGTTGTATCAGTGGACTTAATTTATGTGATGTGCACATTTGATCATTAAGATGCACATCAGTTTGAATCAACTGATAAAACTTATTGCAAAAATTCTTTACTAACCCAGAAAAAAAATCCCAGATTGCTTACTTTCTTTTCCAGGTATGTYCATTGCTGGCAGTGGAATTCCCTTCTGAGCTTTGGGCMCAAGGAGTTAAAAACAAATCAGATAAGACATACGTCACCTGTSCATGATTSCCTTAGTAACAATTTAAGAATTTTGGTCAGTTTTTCTTTCAAAATACTTGTAAGCAGTTTTATCCCATGAKGGTGGACCATCTAGTGCTGATACATAAAMCTGGTATCTCTAAAAWTGATCTCAATATGAGTGAGTAACAATACYTWACATTACCAYCTAAGGGATTGTSCTTAGAAGGATCTTTC

SEQ ID NO: 23 - DNA, 1546 bp, Homo sapiens
cacggccggagagacgcggaggaggagacatgagccggcgggcgcccagacggagcggccgtgacgctttcgcgctgcagccgcgcgccccgaccccggagcgctgacccctggccccacgcagctccgcgcccgggccggagagcgcaactcggcttccagacccgccgcgcatgctgtccccggactgagccgggcagccagcctcccacggacgcccggacggccggccggccagcagtgagcgagcttccccgcaccggccaggcgcctcctgcacagcggctgccgccccgcagcccctgcgccagcccggagggcgcagcgctcgggaggagccgcgcggggcgctgatgccgcagggcgcgccgcggagcgccccggagcagcagagtctgcagcagcagcagccggcgaggagggagcagcagcagcggcggcggcggcggcggcggcggcggaggcgcccggtcccggccgcgcggagcggacatgtgcaggctgggctaggagccgccgcctccctcccgcccagcgatgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaaacaaaaaaaaaaaaaaaa

SEQ ID NO: 24 - DNA, 1154 bp, Homo sapiens
gtctgcagcagcagcagccggcgaggagggagcagcagcagcggcggcggcggcggcggcggcggcggaggcgcccggtcccggccgcgcggagcggacatgtgcaggctgggctaggagccgccgcctccctcccgcccagcgatgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactttaaactcgtccccagaggaggacttgaatgaggaaaccaacactttgagaaaccaaagtcctttttcccaaaggttttgaaaggaaaaaaaaaaaaaacaaaaaaaaaaaaaaaaaa

SEQ ID NO: 25 - DNA, 2121 bp, Homo sapiens
cggccttcctcacccaccatgtctcggcagtcctccatcaccttccagtctggcagccgcaggggcttcagcaccacctcggccatcaccccggcagctggccgctcccgcttcagctctgtctctgtggcccgctctgcagcagggagtgggggcctgggaaggatcagcagtgctggggccagctttggaagccgcagcctctacaacctggggggtgccaagcgggtctccatcaatgggtgtggcagcagctgccgaagtggctttggtggcagggccagcaacgggtttggagtcaacagtggatttggctatgggggtggagttggaggaggcttcagtggccccagcttccccgtgtgtccccctggaggcatccaagaggtcactgtcaaccagagtctcctgactcctcttcacctgcaaatcgaccccaccatccagcgggtgcgggccgaggagcgcgagcagatcaagaccctcaacaataagttcgcctccttcatcgacaaggtgaggttcttggagcagcagaacaaggtcctggagaccaagtgggccctcctgcaggagcagggctccaggactgtgaggcagaacctagagcccctctttgattcctataccagtgagctccgacggcagctggaaagcatcaccaccgagaggggcaggcttgaagctgaactgaggaacatgcaggatgttgtggaagatttcaaagtcaggtacgaagatgaaattaacaagcgcacagctgctgagaatgaatttgtagccctgaaaaaggacgtagatgctgcctatatgaacaaggtggagctggaagccaaggtcaaatctctgcccgaggagatcaacttcagccactcagtctttgatgcagagctgtcccagttgcagacccaggtcggtgacacatccgtggtgctgtccatggacaacaaccgcaacctggacctggatagtatcatcgccgaggtcaaagcacaatacgaggacattgccaaccgcagccgggccgaggctgagtcctggtaccagaccaagtacgaggagctgcaggtcaccgcaggcagacatggggatgaccttcgaaacaccaaacaagagatctctgaaatgaaccgcatgatccagaggctgagagctgagattgacagcgtcaagaagcagtgttccagcttgcaaacggccattgctgatgcagagcagcggggagaactggctctcaaggatgcacgggccaagctggtggaccttgaggaggccctgcagaaggccaagcaggacatggctcggctcctgcgtgagtaccaggagctgatgaacatcaagctggccctggacgtggagatcgccacctaccgcaagctgctggaaggcgaggagtgcaggttgagtggagagggagtttctccagttaacatttctgtggtcacctctactctttccagtggctatggacgcggcagcagcattggaggtggaaacctgggcctcggtgggggcagcggctactccttcaccaccagtggtgggcatagcctgggtgcaggcctgggaggttctggattcagtgccaccagcaaccggggcttagggggcagtggttctagcgtcaagtttgtctccaccacatcctccagccagaagagctacacgcactaagagagccccatggctccctctaccctgccttgaggcctgtttgcagtcacacctggacaccagggtcctcctccttcctctctccttgtaaggtgcacctgtgctgctgggagcctggagtactggctatacccattcccaggcctaagccagcctctccctcctgacagtgcccagactgccagcagcacccgtctgttacacatgtgaaaccaaagcctgctctctcctaaggctctcattcagcctatcttgcgaggcccgggcagctggaaagtcctcctccagctccacctccctccctccctccagatgcagaggctggggagtctctcaatgccaggttgtcacccacctgtctcatagtgtttataagtggcctgctgggagtgagtgctccctctgttccctccctggaatgtgtctattaaatgcatgtgtcacctg

SEQ ID NO: 26 - DNA, 1607 bp, Homo sapiens
aatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcaaaa

SEQ ID NO: 27 - DNA, 1512 bp, Homo sapiens
ggggtactcggcggcggcggagcgggcggcagagcagggcggcggcgactcgcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacatctataacgataaaaaattcctaattgtcaaaaaaaaaaaaaaaaaa

SEQ ID NO: 28 - DNA, 559 bp, Homo sapiens
  misc_feature (422)..(422): n is a, c, g, or t
  misc_feature (460)..(460): n is a, c, g, or t
  misc_feature (489)..(489): n is a, c, g, or t
  misc_feature (500)..(500): n is a, c, g, or t
  misc_feature (533)..(533): n is a, c, g, or t
acttgccaaacatttattattaatttttcacagtccaattatttcaacaagaatatatctaaggtattatcaataggcctcaaatgattgtgggcaaatgggtcttgtcaaagggcctctagaaatttgcccctatgttcacacatttttcccttttacacccccaacatgctctatgtgatctcttattggccctagagtaagacagatgtttatgggattctgagcagcttccttctaacaagctaaaattaacaaaggttcataatattctgaaactcatcaaaacttggggaagtagaatgaacactatagactacaacagacacagttttaaaatttgaactctgaagttgagaaacacctcattatttcttccatgagattatgtgtttaagtggagttgagtttaaaaaaaatcnaatttaaattccaaatcttcaaagctaaaccctattcntaacagatatttcttccagtaatggggcnggatttttacnggggagttttttatgccgagggtcactcccccnggcacctattccagggggttataaaa

SEQ ID NO: 29 - DNA, 562 bp, Homo sapiens
  misc_feature (456)..(456): n is a, c, g, or t
  misc_feature (468)..(468): n is a, c, g, or t
  misc_feature (485)..(485): n is a, c, g, or t
atacatgtatattatttattgttgattctgtacaccaaatggattacaagcagcatccagcagaagacagaccccccaaccctgcccaccagggctcacactctacaaaaccctgagggcctagaaatctgtaaatgcatcgccaagcactggggctgatttgcagtaattctctaagcaaggcaaacatgatctagctttgaaggcagcatgaaggcagcgggttggtgagaacaatctctccttaagagaagaagaaacctggggcggaaggagttttccccggaagtggcttgccagcccaccctctctgaaccacagccatggcttccttcccaaggccactgctggcttcccaacaacgcagattcagttctgactgtgggatctgggggctgaatctttgaatggtttatggctaaaagctaggatacatctaacatctggcgacaactntgggtcccgagntatctctaactggctgntctttggaaactttctgagttggaagttctttccaatagctttacatagcatctgaaaggttgtggaaattgggtcc

SEQ ID NO: 30 - DNA, 5044 bp, Homo sapiens
ccccgggctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctgatattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctcaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttcaaaaa

SEQ ID NO: 31 - DNA, 2617 bp, Homo sapiens
gacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttactgaaatattttaa

SEQ ID NO: 32 - DNA, 570 bp, Homo sapiens
tttttcaatatgtgtggtactttattttttatgttctttttttaaatctggggtattagtctgtgctttgggagaaatgcactagctctgcaattcccagctgggcaagtgtgtctctagtatctccacgcaactgatacactggtcccttccccatgtcctctccaggcactgtgggtcttgggaagtggttcttgtcagcccgagggacactgggttctccactgtccttcacaggaaattctagcttcctcagcctttgtgccaccacacttatagcttcctgtgcaaagtatttgacatccatgtcttcatcttgacctaacttctgtagtactggcttcacttctccctgtaaagcattggtatctagaattggtccaatcttttgtagagatttggccacattgaagcgaacatttgctacttggtctcctgccatttttaatacgatgggcagcatttgcttagtagttatttcctgaccacaggcctcagacagtgcattaatgcagaataaagtggtcattctatgcaagtaattaggatgatttgccattactaacactt

SEQ ID NO: 33 - DNA, 3583 bp, Homo sapiens
aactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccatgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtggcccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 34 - DNA, 1732 bp, Homo sapiens
tttacggcgcggagccggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctgaaatttaatagtgtctttcataaatttaactgggaaacgtgagacagtacatgttaattatacaaatggccatttgctgttaataatttgttctcaactctaggatgtggcttggtttttttttttctcttttcttttttaaacaagaccaagatcttgcttattcttccatgaaaaaaaa

SEQ ID NO: 35 - DNA, 1588 bp, Homo sapiens
ccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcacgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgat

SEQ ID NO: 36 - DNA, 1889 bp, Homo sapiens
agagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttattggggttgctcacaaatactaggggtttttgttgtatttttaacaaatatatcctaatgtcatatttattctcttttgtaactgctgtctttacaataaagaaatcatctgcctttctaaaaaaaaaaaaaaaaaaaaaa

SEQ ID NO: 37 - DNA, 12926 bp, Homo sapiens
gaggcccggaggaactcggagggggagggagagaaaggccgagacggagggagccagcggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaagaaaaaaacatggtcttgtttttactacctgttagatatagtgctaaagaggtgctggcatgctttacagcacagatctgattttttaaaatgtcctgtactagtacataaatcccgtcatgcactttttttcatacactacaaggggatgtgtaataaccatgcttcttttttatccttaaactattgccatacttcagtaagtgtcttttttaaaaaaaattcacttgtataaaaatggtctggtcagtatagggcacaaatgccaaacaaagtattagtgttaacacaaaactgccaactttgcacaagtttccagaaaagaaaatacaattagtcactcaacataaccacaggccaatttgttggccaccagaaaaccgctttttaaaaaaacacttggtgattctttcaagtgccgaatgttattagaatcaacattgcatccttcttgcttatacgttaagttacataaaaggaaaacaaaattatgtggtgtgaaacagccaaggcatttattcttcagaggcaggataatatttcaggatacaaaagcccaaattacccgctacggaacaaagatgaatacagtaaaagagtcgaacactcatttccaaggccctaacccttatcctttaaaaagaaatcctctgaactgggtcggtctgttgtatggctgtctaatttgttgcaaattctgcagtcgtactataattcaggcctgtttggtagacaaaatcaaaaggcatttaacagcagcagtacttggaagctttgaaaacatgtgctaaacttgaatggagcaacactcctttctgaaaagccagaagaagggggttttaaagcaggatctctcaatgttcagtgttttgtgtttccccacacgatttgtcagagagaaatgaaagcaagcctgaaaccaagcaattgagagtgagaaagaggagagagactattctccaaaccttttttgttttgttttgtttccgatgtttacacatgttgcctgagctggttaaccacatcggcagcctcagctaccacaacatactgactaaatgatgatatttactcaagttcagtctgcagccaaaaccattagggtgtgcattgcagactgttttgttgtcttttttttttcttttttcctttttttttaagtggaggggaaaagaagagataaacaaggaatattttgtcaaacagtacacaataatttaaagagaatgtatttcttttttgcatttaatggcctcagacatttctttcatcagtctaaaagttagaaatatccctttattttaacttttatgtcgtttccatttttcatgtttttgtaattattttttctatgttcacatcagcattcacttccgttaaatttgccaaaggaaactgttaatatgtttctgttgttattattcctgtaggatttattgtacctcacagtatttattgtttcccaaaataagcatcattagttggggattcagtatttttgttgtgaaaatttcagaaacaatagattcttaaagataagctagctatgtctaggagctttatcttttcacctccttcagaggatgctatggggtccattttaattcttcatttgttctacggggaggaaagaccaaaagtatttgcagtacaaaagaaactatatcaaacactatgttaaatgacaagtgtttatggtaaaaagctgaggaattagtaataatcgtttttgttttcttgtactttgaattccccaaagtcttaattgctttattttggtgttgtgttaaattgaacagacagatgttttcctttgttttataccatataagactctgtacagtatgtttgtgaaagattgaactagaataatgaaagtttgtttgcaaacattttggtcctctcagcgttctctgtgttgtgctgttgccccattaccaaatggttagattcaaaaagggtgggaaaagatttttaatatcccaacaaaacattatagaaactctggcttttgcagtgtgcatagactacatgtagttttatgaaaataaatacacatttttatttcagcaactttgaaaagttacactcagttgagttactagaactcatcttgtacaacagcaatgtttagtctgtttaatttaatgtcaaataaaaggtcagatagccctcgtgagtgaattacatagctgtcggcagtcacatcagcaaatgcaccaggcttagaacaaatgtttgttacttgctgcaaaccaagctaatgtgtatagccagttagaaaaagtccagaagtaatgagattctagaagtagagtttcccttgcttggaaacatgaatgtgttcacctgtgttttgtcagagaagtggcaataagtcctggacagctgacactttttaagtatctcccctatttgctactacttttgtgcctcaagtgcccagtcgttacggtggccttctaaatgagtaaataacattttccaatataaagcctatttgcttaaaagggacaggggagtggatggatgtagtacatgcaatggaaaatcataaaatgtacaattcttctgtttccaaagtattgctcgttcttgagtgtgtgcctgagtgtcttgttttgacttaactagaattctagttaagatggtgatcccatggcttatttgcaaacaggaaggataaagagatcagcgttttagtcatggagctcatctttgcccattcctactcatttgctttttcataggagttttttgttgttaaacagtttctctcaagccacatgcattctatgctggctgaaaattaatagtgatgtagatgttcatccgacaagcttttccccatgtgattggttttagccagagtttatcacaggtacaaaattaggcggtatgactgtgcatgttctctagctgatgttgaaacttgtactgtcttgatcatttaaaactatgtttttgtaaatatcaggtttagtccgctttcgggaatatctgcatgctatggaaagagagaaaaaaaggatagataatgaggaatttggtttaaaagtgtgataaaaatccttggcattctttgttctgatattaattgtatttaaataagtcaacccaatgtaactcattccagatcttagtccagctgccctgttcagcctgatgccttttaaaggtttaaaggtgttaatgttttccttttcaacatggcaaacattttttaaaacctttttggcacaatggtgccactgtcctcatagtgttatttctttggtcatgaattttcaggcccttccagtaagaggagaaaggcacttaactggttaacagccccattattatacattgctctaaggaaaaaaaaaaaaaaaaaactttgaatatatcaagaatgggctattccagaggcttctcctcaggagaaactatgcactaggttcccaccaaatacaatgtgacctttttttcccctttctctgtacacaccccagatatgtgccaagcaaatgagaatgagggccgttgacaattaaagcataaagaagctagtcaccagattgagatggacatgctgctaactgctgacagcttgacctgagcagtcctaacttgtatctggtctgttagcattgggttagattgactaacagagtaaataaaattcacctgtcataagacacgctacatctgctatcatcaagaaacaaatcatccagaagaaactttttttcatcctgtggtcacacccttttcttaagagcttcttttttaaaattatgacaaacgaatttcattctttaaaatcacttatcttctcccaaacttgaagtatttaaattaggtggttttgcttttccctctcattgtttattttttggggatggatctaaatgagtaagatgagcaataaaagataccagaaagactggagggatcacagtgttttcatcagaactaagtagagggtcggttcctgccctggttttggggtagctagaaaaggaaatcatgaatgcactggaaatgttggctcgagagaaaagactggcatagctctgcctcgcagtgggtgagagcgtattgatcgtagggacctgcagagttcctatgaccaggtgagtcggctctgaggaaggggttaggaaagcaagtacagctgcatgaaatagctgaagttcctttggggtcaggaagagccgacaattgtggggttttggttgcttttgctttgtttttgagtgggaagtgttgctggaatcccctgagaaccgaaagatgccaggggtcagcaaggctatagaaaaggccagtggtaacacctcgttttcatcctaacagaggagtaggtgcgaatggcaccagcatggatcgttcctttcttgatcattactcatgcttgccactgtagcaacacaacaaagccatgattgtaattaatactaggctaaagaccttgatcaaaatgggagctcatttactgttctatgaggtatgtaagtaacttctcttcacattttccctcagagataaaccacacgtggtagtcttgtttgcgttagtactaaggtcatgtttgatctgtcccagacgagtcgcatatttcctgtagctggagtgttgctcaccataaatggtcattttcaaaaagtattgtgtaattccagctgtacaactgaccagtgagttatctgtcatcactgttgcccacatacccgtccttccttgtgtagtttcatcatcctcatccttcccacatcttgcgcaaaatgattttctgtgctcattcggcaataactatgttattcggcatactgtctttttggcatttgttgaaaaatccaaatgcttttaatccaaaagattaatccaaatcttttttaatccaaatgattttaatccaaatccaaataacaggaggttaaaaaaaaaaaaaaaactaagcatttttacatgtacactgaattggatcagcattattgttcattataatgctatatatatttttggagcaacatactatagttgtcataaaactatctttattcttctcctctaaagtgctgttgtaaattcatttgacctttactgcaggaaaaaaaaaaatcttttttatataggatatgaagaccaaggctcagtctgtaacaaatagtggaccattacaaaagaggaaagaaaaaagccagggctgagcagcaagaagcttcagttcaatttcacctcgtatctttctaataacatacttgtcactttattaccttccagtaatgtgaacgctgctgacaagactgtcacactaacagcagacaacaccctctctgcttcagcccagctctcctggctacttattgccctggccctgaagggacacaaactaatagtgtgctttccagttcagcacttggccatcaaatataaaaggatgcgtaattgcctgtttatccccttgtgaaggagaaattgactacaagggctaggctttcccatcgagttccctgatgtacacacacatccacaatcagtcagtctctctctctctctctctctctctctctctctctctctctctctcccctctctctctccttccctcttattctcccctcctaacatacaagcacatacacacacctactgtatctgtgggaagcccaaggctgcctctcgatgccctctccagctattaagtggacagtaacaagatgacttcttaaataaagggtcagtagagagatgctgtctgtgacggcatcctttgcttctttgaaaacttaagtgttaacaattccatcttgagagtaatgggtgtggccctataattagagcaaattttcctgcaagtcagtggcataagtaagattatattgccccctaatctgtagggaaaagattaaaatatttttcttccccttcaaaaagtgcacatgttgtaaactggttacgcacagtggtcatttttttttcttatccttggcatcaaaccatggacgtaggtgtacaaatgcatctttcaatgacccctccaaatccatagtgtaacatgatagattaacttttgtcaaactggactgacaatctaaaaaagatggcgtcaggcttttgactttaatcgttaaaacaaggaccaccctatgagtaaaaggtaaattctccactttgaagaactttggtaagtacaagtacagggagctttagaaaatcgagtgatggggaccaaaggtacaaaggaagaatacatgaaaatgttatattccaaaatgccctgagcccaaagattggctgctatttttgtatattgaaatactcaaatgatggttggaaagtgactagttagtgactaaatgaagtgcaagatctatcaagcgtcttctttctgggactaggggatgccatgcttccttccaaccttcccgcagcgcatctcagagaagatagttggccccattacaaacagtcacatttcagtaagatattagtcagccaggtaagacacgtgcaggtatcggtatcatcttccatatgaactttagcaaggagagaacagcagcagatttagggatagacaatgtaacaggtctatgttgacaaatctgtgctaaataatttcatgaaccagtgtggggactgggaagaaaagcactttgagcaaggactcttgggttcgagcaaaggcaattagttgacatgatacttcttaagttcctcagtatgtatatgttacaatcgtttatcagacatcttaatagaatcctaattgaaaaaccagttgccaaaattgcacaagttctgctcgctgatactagctttctccccttaactctaaaataccagggatgcttaaggacgtttgtaatagtttttttaatgctttgtttcacttttttaaaaaagaatctttgaagggaaggaagagcagaaagaagtattttaagaaaaatggagagaagtagatagtattgaaagtatatttcttgaagagagagtatctaagtgctataccaagattttatagggcttcctgttgccaaatgtgatgttgagataatgcacagctaagatggcaaatccatcaattattaactggctctgcccacttctgtcatggaatgcaaggattgagaggtgactctggggagaccctgggtgtgtgagagagctccattcatctggccctggatatgtttttcaaaagagagggagaaagcgccagtccctgcaaggtgaactgacctggcactgtttcagtgggagcctcactgcctgccttttccatgctaggagacaaagcatcctctaccccatctgtgaatcggtgctgtggccactgcgagaagcatgattcatgaggtatgatgctcttgagctcccagacaatgtgctgagttaataggttcacttgagatgtatacaccaaggctgtttctttttttaaatctagtccccaatttggagtatttttgcatgtttttgtacagagtaatccattcctctcattgtgtatcttaatctcctctgacttttccattgtctttctcaatcccaccctttgctcttcggatctcaccaaccccccttaaaaaataaatcatgtttgagcaagaaggtagaacacgccctccctcatcttggttttaattgctttggaaacgtgttctaccctgtccagggtttgcataacgtgaattaagtgaatgagatgttctagtattatatcttaacctgataagactatctaagatttctagtatatggtgcatttgctttcctgtgcaaactttggttcagctgccctgcagagaatctcaccattttcctgccagtgccagtataaagaatgcaggagagctaaacctgggtacatgaaggtcagaggggtgaggacggtcgagaaatggggagaagacttgggcttgagacgacctgggcttttcatgtgtagctcactcagcagtatgaggatgactgacacaccagtgggtggtttccaagtgaggcaaatgcccatttcccctctcccctcacaccttgcctggcttcttccatgaagtccttgctgcttttctgcctccccaaaggtgaggggaaggggctggttggggatctgggaaagccagttctctgttctctcctgctggtgatggactaggccttttagaactagcaagatccctcacacagctgggagaacacacacctttcttactccagacccattggtgtgtctccagtaacaaaattattggactcagcctccatatttgacagcaaaagtggccagagggagttgaaatatcttgaagaaaaggaattttcactaagatatgtcctctccctctcccagagtttagctgtttattccttttttttgtttatattgttctcatctgcataaaaccagtctcttgcaataagcctgccgcagaatcaaagtctgtacttcaaaaggtaactgcaccaagggatgggacagtgtgcatcaccctgatctaatcattgtgacgttggtagcttcctaaatactgtatgtaccttgaacaagggttttatttttgttttgttctgttttgctttttgtttttattggtaggctaaggtaattaaattttttaatttgctgttactttggttgtattttctgtactataactgcctacagtatgtcttttgcataaaatgcataagggtttggggatgtaaatggaattttattcatattttgtccaaatacctcttgtaatttgtatcaaaattcttgtacaatttttatattaaagatttatcagtcactga

SEQ ID NO: 38 - DNA, 1119 bp, Homo sapiens
  misc_feature (18)..(18): n is a, c, g, or t
ataawaatttawtwtadnttcattttactgtttgtaactaatcatgattttgtgaacttgcctgtataagtctgtaccttcaaatctacaaagcaaaagtttactacaatgagcacttaaaattccacaaaccgtctccatccacaactttcctgtacatgcaaattctttcagtgggctgcaatatttgcaaacatgctttaaacttccataaagatgcaagatattttgctttctgctaaaacctttacactctcttgggaaccttaaccaggaaaatgtttaaatgtatatcccaactctaaacgctgccggtttggttatatgtattaaatcgttaaccaccgggttgggtggttttgagttgaaaccttcacctaaatgataatatcttaacggtcacgcatatgaaacacattcagtaacgtaccattataaaatagggttccattaaaaatacatactggcagttgtatttgtgttttaggcaggaaaaaaagcgtgtttaacttttttatatgaatatagtttaaacaagttattctgtgaaagtatgcttaataaaagatctttctgaaatttaaacactttatgtaaaagggtacaggtagaaaagtacaattgctatttgaaaaaagctctgtttgttaatattgccttccaagatagtaagggtgtttttctctctcttcccttaaaatagacctatgacacccagagttgtagggtttgcaaatttggactataaacatgaagaccgtacttatcttatatacaaaaacttgccgcattgaacgaggcaggaatttctaccccagtkgtagtggtctcctttatgtacataatgcagawgtgaaaattatacagtagtcactgatatgaaggaattgtatactctagtgccgtcyggggattttgtgctgtkkgtaatragtcttkgatcgtcatccagttatcgagattttcttattcctcttcttcatcatctttttgtgggtcagttcgrtgatgtcatctcytcctgtcatcggctgytgctgyccttgtrmawccaacytgtctgatcatgactcgcgckstgygctctcttggcttacawgkkstgttctctctcytgct

SEQ ID NO: 39 - DNA, 3084 bp, Homo sapiens
aagatctaaaaacggacatctccaccgtgggtggctcctttttctttttctttttttcccacccttcaggaagtggacgtttcgttatcttctgatccttgcaccttcttttggggaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgacgccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagctatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaaccccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaagcacagcctttgcccaaaactgtcatcctaacgtttgtcattccagtttgagttaatgtgctgagcatttttttaaaagaagctttgtaataaaacatttttaaaaattgtcatttaaaaaaaaaaaaaaaaaa

SEQ ID NO: 40 - DNA, 3046 bp, Homo sapiens
agcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagcagacttttgtgtaaaaagcaaaggttacatgtgagtattaataaagaagataataaataatattctttttaaaaa

SEQ ID NO: 41 - DNA, 3150 bp, Homo sapiens
ccacaaagggcacttggccccagggctaggagagcgaggggagagcacagccacccgcctcggcggcccgggactcggctcgactcgccggagaatgcgcccgaggacgacggggcgccagagccgcggtgctttcaactggcgagcgcgaatgggggtgcactggagtaaggcagagtgatgcgggggggcaactcgcctggcaccgagatcgccgccgtgcccttccctggacccggcgtcgcccaggatggctgccccgagccatgggccgcggcggagctagcgcggagcgcccgaccctcgacccccgagtcccggagccggccccgcgcggggccacgcgtccctcgggcgctggttcctaaggaggacgacagcaccagcttctcctttctcccttcccttccctgccccgcactcctccccctgctcgctgttgttgtgtgtcagcacttggctggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtcgaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtgattgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggcatttcattctataaagtc

SEQ ID NO: 42 - DNA, 1629 bp, Homo sapiens
attcatgaaaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaaaaaaaaaaaaaaaaaaaaaaaaaaaaaaaaaaaaaaaa

SEQ ID NO: 43 - DNA, 2880 bp, Homo sapiens
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 44 - DNA, 6158 bp, Homo sapiens
  misc_feature (2434)..(2435): n is a, c, g, or t
  misc_feature (2586)..(2586): n is a, c, g, or t
aaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatnnccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagagggnaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccaccaggaaggatgggctgcccaggacaccctgggcaacgtggggagactggatttcaaggcaagaccggccctcctgggccagggggagtggttggaccacagggaccaaccggtgagactggtccaataggggaacgtgggtatcctggtcctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttacgagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtggcaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtccatgggggccacctggtcctccaggcccaagaggccctcaaggtcccaatggagctgatggaccacaaggacccccaggttctgttggttcagttggtggtgttggagaaaagggtgaacctggagaagcaggaaacccagggcctcctggggaagcaggtgtaggcggtcccaaaggagaaagaggagagaaaggggaagctggtccacctggagctgctggacctccaggtgccaaggggccgccaggtgatgatggccctaagggtaacccgggtcctgttggttttcctggagatcctggtcctcctggggaacttggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggcttaccaggtcctcaaggcccaaagggtaacaaaggctctactggacccgctggccagaaaggtgacagtggtcttccagggcctcctgggcctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacatcgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtacgtccagaaaaggctatgaaaaaactgtcattgaaatcaatacaccaaaaattgatcaagtacctattgttgatgtcatgatcagtgactttggtgatcagaatcagaagttcggatttgaagttggtcctgtttgttttcttggctaagattaagacaaagaacatatcaaatcaacagaaaatgtaccttggtgccaccaacccattttgtgccacatgcaagttttgaataaggatgtatggaaaacaacgctgcatatacaggtaccatttaggaaataccgatgcctttgtgggggcagaatcacagacaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccgctgactctaatttatgaggatgccgaactctgatggcaataatatatgtattatgaaaatgaagttatgatttccgatgaccctaagtccctttctttggttaatgatgaaattcctttgtgtgtgttt

SEQ ID NO: 45 - DNA, 2416 bp, Homo sapiens
gactgcagagccggggctgggctaggcgcgcgcttggagagcattgcgcgcggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacgaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaag

SEQ ID NO: 46 - DNA, 700 bp, Homo sapiens
  misc_feature (551)..(551): n is a, c, g, or t
  misc_feature (573)..(573): n is a, c, g, or t
  misc_feature (626)..(626): n is a, c, g, or t
  misc_feature (634)..(634): n is a, c, g, or t
  misc_feature (638)..(638): n is a, c, g, or t
  misc_feature (644)..(644): n is a, c, g, or t
  misc_feature (655)..(655): n is a, c, g, or t
cattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattctttacttattctggaagatctggctgaaggattattcatggaacaggaagaagcgtanagactatccatgtcatctttgntgagagtcttcgtgactgtaagattgtaatacagattatttattaactctganaaaaaaanacancataanctcttccttcntaaccctttcctcaaccaaccccttttccttatacatcaaaaaat

SEQ ID NO: 47 - DNA, 2239 bp, Homo sapiens
gaattccgtcccgagctccgcaatgaagacgtgcagctccgactcaacagtattaagaagttatcaacaattgccctagcacttggagtagaaaggacccgaagtgaattgttgccatttcttacagatacaatttatgatgttgatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaaccagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcggctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtattccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttccggaattc

SEQ ID NO: 48 - DNA, 738 bp, Homo sapiens
agtccagacagcctgggaggggagaaggagttggagctcaagttggagacagcgaggagaaacctgccatagccagggtgtgtctttgatcctcttcaggaggtgaggagaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttcaaaaacaaaaaaaaaa

SEQ ID NO: 49 - DNA, 3773 bp, Homo sapiens
gtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctgggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatc

SEQ ID NO: 50 - DNA, 2435 bp, Homo sapiens
aggggtggagagaaaagaggggagggatggggggaggggaaacaggagcgaggtgtctccctagctcgctgcctctggcaagtggagtttttaaaaagctccagcagatcatgtcatgacgacttcgctgctcctgcatccacgctggccggagagccttatgtacgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgctaaatagggctcctctctcctctctctctctctaggtggtaaggttggggattagtccaggtacagaagcagaacttttttctaaggataaacatctcttccaaggggatggagagtgggtccctcaacaaagtccctgtccagtcacctttccatcagggcactagcccaggaatgactcctcacactttcacctttactgatttccagaggaaagctagaggatctagttcaagaggcaagaagatctggccctcaattagctagatgtagatgctgcctaacagttccctcctcaaaggccaccttggtgctgtgggggccccttgcctcttcccttcccactggtgcattacaaaacagtgttcttttgaaatgttcatcaggaataggcttttttaaaaaatgttgtgtatctgtatatagtattgtgatgtctgaatgacaatgtactgaatgcaaaaaggaaaaaaacccacaaacatgtttttaaaataaaatatctttttttgccttgaaaaaaaaaaaaaaaaaaaaaaaaaaaaaaaaaaaaaaaa

SEQ ID NO: 51 - DNA, 522 bp, Homo sapiens
  misc_feature (195)..(195): n is a, c, g, or t
  misc_feature (234)..(234): n is a, c, g, or t
  misc_feature (294)..(294): n is a, c, g, or t
  misc_feature (312)..(312): n is a, c, g, or t
  misc_feature (314)..(314): n is a, c, g, or t
  misc_feature (338)..(338): n is a, c, g, or t
  misc_feature (357)..(357): n is a, c, g, or t
  misc_feature (389)..(389): n is a, c, g, or t
  misc_feature (441)..(441): n is a, c, g, or t
  misc_feature (459)..(459): n is a, c, g, or t
  misc_feature (494)..(494): n is a, c, g, or t
  misc_feature (506)..(506): n is a, c, g, or t
  misc_feature (514)..(514): n is a, c, g, or t
ttccattgaacacatttttattgagcacctattatgtgcaccagacactgttccaggcactgcgatacagtagaagataaaacagacaaaaataccagccttacagagctcctaaagcctatattccagtgaaatcaagataggagaacttttcccttaagtttaaggtagttaaaaaaaaaataggagaactanttcatggagaacatggccaagttatgagccaaagcacanttcctctgaagagtaccaaaacaaattctctctctattgcttaagtcagaagggaaacantggaaacccctgagggtncnaccaccaaaagacagaggccccgntggaacccccgacccatgnttgaggaaagccaggggcccactctccctctnttcaaacagttttaggggtaggagaagtcattgctttaggggctcctcactnggggggacacaaggggcnttttttaaaagttttgttcccccaaaacatgggcnttttcccaaccngggttaangcattggg

SEQ ID NO: 52 - DNA, 2000 bp, Homo sapiens
cctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgtatttatatgtattatacctgtcacgcttctagttgcttcaaccattttataaccatttttgtacatattttacttgaaaatattttaaatggaaatttaaataaacatttgatagtttacataataaaaaaaaaaaaaaaaaaa

SEQ ID NO: 53 - DNA, 1302 bp, Homo sapiens
ggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccaggaaaaaaaaaaaaaaaaaaaaaaa

SEQ ID NO: 54 - DNA, 1469 bp, Homo sapiens
ttttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtaggccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtcccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactacgtgggcttcatcaactacccctcgtgccgaattcttggcctcgagggcca

SEQ ID NO: 55 - DNA, 1887 bp, Homo sapiens
gcttgaaatcgaattcgggattcgggggggacgcaccagggagggaggggtccaggcagctgggccgccgcggacacctagcggcttcagggtgaaccccgaccgcagccgtcgccgcctcgggcagagtttgcgcccttgctttgcgccccgctgcgaagccgggcgggcgatcggcgcgtgaaagcgccgcgcgggcgacctctgtcctagtctcctgctccccccgccccgcttgtcccgtgcccttgtgacccaggctttggcgccgtcgccaggccccgcaatgtagctgcccctgcgcctcggcggaggctcctgccccgcgagcgcccggggcccggagccggcctgggggctcagccgagctcgggcggggccggggcgcggtggcgatgcaccgggccgttagcgccaggagccaggcagctgaggcggggggcaagcctccctcggagagccgcgcccccggcccgcgtcccgccgcgatgctgttccacagtctgtcgggccccgaggtgcacggggtcatcgacgagatggaccgcaggcaagagcgaggctcccgcatcagctccgccatcgaccgcggcgacaccgagacgaccatgccgtccatcagcagtgaccgcgccgccctttgtggcggctgtggcggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactaccggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtgcaggcggcgcgtgcacgcgcggcggccaagagcgcggggctgggcgcagcaggggccaaccctctgggtcttccctactacaatggcgtgggcactgtgcagaaggggcggccgaggaaacgtaagagtccgggccccggtgcggatctggcggcctacacacgtgcgctaagctgcaacgaaaacgacgcagagcacctggaccgtgaccagccataccccagcagccagaagaccaagcgcatgcgcacgtccttcaagcaccaccagcttcggaccatgaagtcttactttgccattaaccacaatcccgatgccaaggacttgaagcagctcgcgcaaaagacgggcctcaccaagcgggtcctccaggtctggttccagaacgcccgagccaagttcaggcgcaacctcttacggcaggaaaacacgggcgtggacaagtcgacagatgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggaggccatgagcctcacagcccctcacaaacgactcttaccaaccttttctaatgactcgcaaccccctcaccccacaatttctttaaaaaagaaattatctttagtttgaattccaagtgtattttaaaatagaggctttgagcaactaactaaccacattttaggatctcgcctggaaacagaggtaaaaaaaagaagtgtgcgcccggctaatgcagcggtgtggaccggaattc

SEQ ID NO: 56 - DNA, 2507 bp, Homo sapiens
cagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaaaaaaaaaaaaaaaaaaaaaaaaaaaaaaaaaaaaaaaaaaaaaaaa

SEQ ID NO: 57 - DNA, 813 bp, Homo sapiens
  misc_feature (688)..(688): n is a, c, g, or t
ttttttttttttttttttttttttttttttttaaacaaacaaaaaagaagtttactaaatttaaacactgacatcctgggaagatgccagtctttacaggcgtttgtaaaagtaaactggggggagtatgttacactaatacaaagttttacaaatgaatacaagtgaaatatttaaattacaatgaaatagaggaagattggggctttgtcctgggttggtttttttagcagtcatattgctgttggggagagcagcaaaagccacatatgcctccaagcactccatttattacttgaataagacacaagatgaattcaattccaccaagagccaagaggatagaaaacagagatacattccattccacaatgtgcttgggttcagtgcactcggaccatgtggaggtatccaaaagggtcttgcccttggggcttggaaaaggggtatttccactggccgagggaatcaagacatagtggtccttctgctaagccaagggctgccacaatgacacagtagccagatcctgcaattccaatgagagcagccaatacagaagaaagcatcgcacatcgtttgccacagttttcatggccacagcagccacagcagtcatcctgttccagcccaatgaagacaaatgctggcaggagcatcagcaggccaccttctacgatgccagaanaagaacacacgaaagcgggttgaggggttttgggaggcattctttgtttcccccttggggaaataaaagcaaattttaacccgggatgccccaggaggcgggccccaaccaaaaaaatgtcggat

SEQ ID NO: 58 - DNA, 5605 bp, Homo sapiens
ggccttcgtccctactgcctgggcgcggggcggggcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgtaactgtttccctttgattctccagtattcctgtttccatccagttccttactctcctctttcctcttccctcgcatgtctccctccagtcctctgtacctagaatagtctcactgtcccccgtttgcctccacgagcctgctgtttccaggaaattacataacgttcagttgggatggaaatcttccggaggacgaatagagtttaattactcattgcgtcggaaagccaagccatttctgtctccagagttgttctcttaaactgatatgagttct

SEQ ID NO: 59 - DNA, 1804 bp, Homo sapiens
ggggccgggcggggccagcggcgcattagcgccttgtcaattcggctgctcagacttgctccggcctccgcgtccgcgcccagcgcgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcctgcccccagagaaacccgtcaacatcagctgctggtccaagaacatgaaggacttgacctgccgctggacgccaggggcccacggggagaccttcctccacaccaactactccctcaagtacaagcttaggtggtatggccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggagtgagtggagccaccccacagccgcctccactccccgcagtgagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgcaaa

SEQ ID NO: 60 - DNA, 677 bp, Homo sapiens
  misc_feature (54)..(54): n is a, c, g, or t
  misc_feature (83)..(83): n is a, c, g, or t
  misc_feature (110)..(110): n is a, c, g, or t
  misc_feature (356)..(356): n is a, c, g, or t
  misc_feature (448)..(448): n is a, c, g, or t
  misc_feature (485)..(485): n is a, c, g, or t
  misc_feature (496)..(496): n is a, c, g, or t
  misc_feature (508)..(508): n is a, c, g, or t
  misc_feature (533)..(533): n is a, c, g, or t
  misc_feature (547)..(547): n is a, c, g, or t
  misc_feature (583)..(583): n is a, c, g, or t
  misc_feature (585)..(585): n is a, c, g, or t
  misc_feature (588)..(588): n is a, c, g, or t
  misc_feature (618)..(618): n is a, c, g, or t
  misc_feature (634)..(634): n is a, c, g, or t
  misc_feature (643)..(643): n is a, c, g, or t
  misc_feature (648)..(648): n is a, c, g, or t
  misc_feature (652)..(652): n is a, c, g, or t
  misc_feature (661)..(661): n is a, c, g, or t
  misc_feature (665)..(665): n is a, c, g, or t
ttttttttttttttttttgcaattttctatttttatttttttaagctcatcaantttggttagtgttagtgtgttttacatgnggcccaagaaaattcttccaatgcggnccagggaagctaaaatattggacacccctgcctaggggaacttgtttcgtctacttggttagttgtcctaattgcattttacctgcagtccaaaggttattttagatgatagaactgcaagaaccccaaacccaaagaaagaatcgttgaagtggttgggagaggaggtcatttctgagatacatttccaggagaaatacaagtttgagagaaggagctggtagttactgtgtgcaagtgtttttntttgatggggaaggagtagttggcaaagggacaggaatctgtgtgtacatttcctgctcctgtttccttaaccaccatcctcagggcatctntggcacctttggggtcgggtaagatgctctctactgncctcgttttanctgcctttatcntcgtctatatggcacttttctgcgntgaaaagacatttnccttacagggatgaaactggacttgcaagagtttgntntanaaggtgttcaagtcaaggaagatgctcaanaaaatggaccccctgnagaagggtnggcantcanttgcttgancttnaaaaaaaaaaaa

SEQ ID NO: 61 - DNA, 619 bp, Homo sapiens
tgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccctgatttagcaagcaagtaattttctcccaagctgattttattcaatatggttacgttggttaaataactttttttagatttag

SEQ ID NO: 62 - DNA, 2199 bp, Homo sapiens
gtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagacatacgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttcgttctgtaggcggaggcaccaagccctgttttcttggtgtaatcttccagatgcccccttttcctttcacaaagattggctctgatggtttttatgtataaatatatatatataataaaatataatacatttttatacagcagacgtaaaaattcaaattattttaaaaggcaaaatttatatacatatgtgctttttttgtatatctcaccttcccaaaagacactgtgtaagtccatttgttgtattttcttaaagagggagacaaattatttgcaaaatgtgctaaagtcaatgatttttacgggattattgacttctgcttatggaaaacaaagaaacagacacagtgcacacagaaaatattagatatggagagattattcaaagtgaaggggacacatcatatttctgcattttacttgcattaaaagaaacctctttatatactacagttgttcctatttttcccccgccccccaccgccccaccacacacatatttttaaagtttttccttttttaagaatatttttgtaagaccaatacctgggatgagaagaatcctgagactgcctggaggtgaggtagaaaattagaaatacttcctaattcttctcaaggctgttggtaactttatttcagataattggagagtaaaatgttaaaacctgttgagaggaattgatggtttctgagaaatactaggtacattcatcctcacagattgcaaaggtgatttgggtgggggtttagtaattttctgcttaaaaaatgagtatcttgtaaccattacctatatgctaaatattcttgaacaattagtagatccagaaagaaaaaaaaaatatgctttctctgtgtgtgtacctgttgtatgtcctaaacttattagaaaattttatatacttttttacatgttggggggcagaaggtaaagccatgttttgacttggtgaaaatggggttgtcaaacagcccattaagctccctggtatttcaccttcctgtccatctctcccctccctccggtatacctttatccctttgaaagggtgcttgtacaatttgatatattttattgaagagttatctcttattctgaattaaattaagcatttgttttattgcagtaaagtttgtccaaactcacaattaaaaaaaaaaaaaaaaa

SEQ ID NO: 63 - DNA, 510 bp, Homo sapiens
tgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatga

SEQ ID NO: 64 - DNA, 809 bp, Homo sapiens
  misc_feature (626)..(626): n is a, c, g, or t
  misc_feature (636)..(636): n is a, c, g, or t
  misc_feature (651)..(651): n is a, c, g, or t
  misc_feature (730)..(730): n is a, c, g, or t
tttttttctatgcaaaagctttattttgaaaagttcagtgatctcataaatagagacactaagttggagttttacgcataaaactccttagtaggtgccttctgataagcagcactggatggtttgcgttctccaaggtcatagcttccttcatccttctttctcatgcgatacaccaacagcaggataagaaaaattgcaaagagaaagccaataactccaccagcaatgacagctgctaggacttctgtccgtttaaacagactgtctgagtgtttctcagtatacacatttgtatcctcttcggctgggtccattttcctttctgagtcagagaggtgaactttctctttatcagtttcttcaggtgactttgtctgagcaggtatcttgttctgtatattcagcgtcgtggtttccacttttggagcagcactagtcaacagtatctttggaagtggtcgagatgttgtcagctctggactctctacatcctcatcagctcccgagccagacgcagaagcatagtcatcgtcatcaataggatacactcctgaagcttcttcaatggagctgttgtcaaggtacatgtctttatcagatgtcagctctgctctcgactccgncgacacgcangccacccagcccaanggtgagcaagattcacgcgcgccgcataattcccaaggacccgctgcttccagcgctggtgcgaacagggcaaaacgancccccttgccgagcgtgggccaaccggcccaccgaatcggaacagatacccgaggattggggttaagctcgggactcgg

SEQ ID NO: 65 - DNA, 1820 bp, Homo sapiens
gcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgtacaatggatgcattgaaattatatgtaattgtataaatggtgcaacagtaataaagttaaacaattaaaaagaaaaaaaaaaaaaaaaaaaaaaaaa

SEQ ID NO: 66 - DNA, 523 bp, Homo sapiens
gatgaaaatctttaatttttatttagttatacttgtacggacacgtgtatatacaaatacagatcgtatgggtttgtttgtgtgtgggttttttttttttacattttcttttacgtttatataatgtcagcatttcaaaacagcactcgatgagtaagtgcaaaggaactgcaaagcagggcagtacaagcacaggaccacacggagctggacttcacacccagacgcacacacaatgagtggcttcaatggggtgtcaagagtaagcatggagagcggattttgactcatgggtaacctccgacatgccagcatctattaaactgtacagacaatgggagcaagcccattgtagggagatttgtctcacatcctagcagccctggggccaatgcatgggaaaaactcagtgatgccaaaccagagacagacctgcccattcacagctctgaggggaaataaaacgtgggaggaaggcaagagacacacaaaaaataaacatactaagtaaaaggggggtggt

SEQ ID NO: 67 - DNA, 2768 bp, Homo sapiens
ggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgaccccccccgctgcgcacgcgcccggccaccggttggccccgggccagggcacaggtaccgcggccgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaaaaaaaaaaaaaaaaaaaaaaaaaaaaaaaaaaaaaaaaaaaaaaaaaaaaag

SEQ ID NO: 68 - DNA, 570 bp, Homo sapiens
  misc_feature (427)..(427): n is a, c, g, or t
  misc_feature (544)..(544): n is a, c, g, or t
  misc_feature (570)..(570): n is a, c, g, or t
attagactaggaaatataatttatttcataaaaattaattttgttacaataggaatgctaaaggttatttataggttgcagtttacagaataaacagaggtgggattgggggccatccctggggccctgcacccccctctcccgggcatataaccatgtccacagaccttggcaggggtccagcccttttgccccaccaagagctccctgcaccaaagctcctggtcacctcccctaagggacccggctcagctgcctaaggagctggggaatagggaccagaagtgccctggagggtccaggagatgagaaggatccccttgcaccctcaggagaacccctacccctgaagctctggagccgggggcacttgtgagagaaggcagagggagaggcacgtagaagattacattgactgaccctgttngcttcagggagggcagaagacaggcacaccaaaccctagacgttccaaacctgggacgcagaggagcacacacacacgctcgcttcaggttgggacacgttgcacatgctctccgangggcatcctgatgtgcccacagagan

SEQ ID NO: 69 - DNA, 3087 bp, Homo sapiens
aagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacaggcctgccagtggtccccgagggctttgtttcaccccactggtggcacacagggccgaagaggctgccgatccctgctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatttggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaaaa

SEQ ID NO: 70 - DNA, 1409 bp, Homo sapiens
ggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgagccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaaaaaaaaa

SEQ ID NO: 71 - DNA, 1940 bp, Homo sapiens
agggcccggagccggcgagtgctcccgggaactctgcctgcgcggcggcagcgaccggaggccaggcccagcacgccggagctggcctgctggggaggggcgggaggcgcgcgcgggagggtccgcccggccagggccccgggcgctcgcagaggccggccgcgctcccagcccgcccggagcccatgcccggcggctggccagtgctgcggcagaagggggggcccggctctgcatggccccggctgctgacatgacttctttgccactcggtgtcaaagtggaggactccgccttcggcaagccggcggggggaggcgcgggccaggcccccagcgccgccgcggccacggcagccgccatgggcgcggacgaggagggggccaagcccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgcggccgctcggccatttctcggtggggggactcctcaagctgccagaagatgcgctcgtcaaagccgagagccccgagaagcccgagaggaccccgtggatgcagagcccccgcttctccccgccgccggccaggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggccagccgattcctccagccctggtgctgtacccccgacgtgctcccctgctcggcaccgccagccgccttccctttaaccctcacactgctccagtttcacctctttgctccctgagttcactctccgaagtctgatccctgccaaaaagtggctggaagagtcccttagtactcttctagcatttagatctacactctcgagttaaagatggggaaactgagggcagagaggttaacagatttatctaaggtccccagcagaattgacagttgaacagagctagaggccatgtctcctgcatagcttttccctgtcctgacaccaggcaagaaaagcgcagagaaatcggtgtctgacgattttggaaatgagaacaatctcaaaaaaaaaaaaaaaaaaaaaaaaaaaaaaaaaaaagaaaagagaaaaaaaagactagccagccaggaagatgaatcctagcttcttccattggaaaatttaagacaagttcaacaacaaaacatttgctctggggggcagggaaaacacagatgtgttgcaaaggtaggttgaagggacctctctcttaccagtaccagaaacacaattgtaaaattaaaaaaaaaaaaaaactctttctatttaacagtacatttgtgtggctctcaaacatccctttggaagggattgtgtgtactatgtaatatactgtatatttgaaattttattatcatttatattatagctatatttgttaaataaattaattttaagctacaaaaa

SEQ ID NO: 72 - DNA, 494 bp, Homo sapiens
aatgaagaaatcttacgttttattgaatactttggccagatcagcccctttgaagggatcactaatttaggaaagaagaacaacaaaccatcattcactttcctgcaggttcatcgttttcctaattatttctatggatcctgctttattctttctgtaaattaaggggcaggaggagagtttctataatagatcagcaatgtctggttcttatccaaatattccacctaataaggatgtaaattctcatggattggacaatcactctgcaacattcctgagaattgaataatataataatcttgaaagtcagcagagtggattatccactttttttttctggacttgaacttgtgaactcaacagtagcactgcaaaaaagcaaacgtgctaagcactttgccagagtaaccttccatgtagacttttcatcttaaatacacacaactgaaaacaactacaatttttggaaaattatgtacaaacccgatact

SEQ ID NO: 73 - DNA, 1831 bp, Homo sapiens
gccaacccactcccacgaaggacaaggacgtggcgggcagcccctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcatctggagagacccaagaccctatctgttaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttataacaaagtccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaaaaaaaaaaaaa

SEQ ID NO: 74 - DNA, 1178 bp, Homo sapiens
acgtgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacgggggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttac

SEQ ID NO: 75 - DNA, 642 bp, Homo sapiens
tttttgctctattaacttctttataggcacacggggagttacaggctgaggacaaatggggacttcacactacattatcttcctctgttcaaatagcttttcagggggagtgagtgcactctatatgatggaggaagaggacattggtgcctgtgggtacttcagcaccaggcttggtaaagcacatactctctgtagcacagccccgcatagcaaatctgggtttgaaaataccagcctgcacgtgtccagataaggagacgcagtggttttcctttccagtacagtgggtcatgggccccatgcatttgtccctgaagctcgcagtgcaggcggggcacatcaggccattctcagtaagattggtcaagggaacagacaaaaaggcactgttgcagccgtcgctctggcagcagaaggagctggttaccatgtttccttggggcccatggtggtggatataacgccggagtagcagtcctgggacctgatgcagcccttgtaggtgtgcaccaactccttgccctctgtgggatggggacaggcagggacagtgctggctgaccactccctggcttcaacccctgcctcaaggtcttgcctaaccctaggcctgcccaaccccacaacttcctgggatgg

SEQ ID NO: 76 - DNA, 1559 bp, Homo sapiens
agcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattg

SEQ ID NO: 77 - DNA, 2740 bp, Homo sapiens
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaaacggcaacggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctactacgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaa

SEQ ID NO: 78 - DNA, 3346 bp, Homo sapiens
ggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagagttgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgaaaaaaaaaaaaaaaaaaaaaaaaaaaaaaaaaaa

SEQ ID NO: 79 - DNA, 3045 bp, Homo sapiens
actaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaatatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagtattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagacggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaagctggataatattatctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagatcacacgcacatagccacgcatacacacacagacacacagatgtggggtacactgaatttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgaaaaaaaaaaaaaaaaa

SEQ ID NO: 80 - DNA, 758 bp, Homo sapiens
gtagttttggcacttttacttgttttttttaaagaaagtgaatacaaatatctttgtacacaaattctcattctggagaaacaggatgtagaattcaaaggtgccaacatctcccttcttaaaaataacattgaaacgggtaactgtacctgttaaatatcctggttggcaacttttaaaatctggcttccacctaactccacaaatttgacaaagttatttttgtttgtgtaagtgatactggttatccacttccagtacatgtaccatttggccagaggtccataaataatattaacattttcagtgtagaaatcttgaagttctaaagggaaatattgctcaatagataaattctcctggaatttcttgtagcaaaggttcctcaaatttaaatcgtttggaaatggccttttgctccattttctctttttcagactgtctgcattgtcctagagtatatgaagtaactacaattaactcttcggttacaatggattcctcggtttctgatttgtcggtatccgaattaatttcaggcacagaatgaccttcttggagggcatttgcttcttctagtgccctttccatcctgaaagaaggctcttgaatactgctctgtgtcaacccagggtgctttagacattcttcaacagtggctcgatcctcagtgtcttaactaaaagtgtcctgatgaaatcgacagccgactcagacaaacatcaaatcttgcctagaatacttaaattcatctgtga

SEQ ID NO: 81 - DNA, 4634 bp, Homo sapiens
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaatatataagtgtaacatgttttcattccaaactggtagtggtatatagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctagctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgtttgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctcaaaaaaa

SEQ ID NO: 82 - DNA, 2014 bp, Homo sapiens
aggcggcttttggtcacaggctcccgagttctcctagctggggctgcggagctggggggagggaagagaggaaaggggagggggtgcctggagaggcggaggctcgcgcgcctgcgcatccagctccagggaccctaggttttctatgggattcccaatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgaaaaaaaaaa

SEQ ID NO: 83 - DNA, 4695 bp, Homo sapiens
ggacccgggccggcccccaagatgccggcgatcgcggtattggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgtttttttttttgttgttgtttattttttggatagggaagtcattggcttaattagagcctccttcctttctgtgagatttttccaacaagcatgtgatttacgtggaattctgacagtgcagggagcccccaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgctactgccggtgattattattaaaaattagtttttttcacatcattatatctggcttcctataaacaacagccttaattcagtcaagactccctttgggaattcattttattaaaaattggtgtctggatacttccctgtacatgcataaatatgcatgcatgtacaggaagactgtatgtgtgtgccttgcacacacacccatacctctcagaaaaagtgggtatattaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagcccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatctatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaacagacagttcccagtaaggtaatgagatgccattttccgagacattctaagaagatattttgattcattaaaacattaaataaaaagccctcctcagattggaacccccaaatcgatggagtcacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaataccgattataaaaatattgtaataaaccacttcctcatttgatactggtattaagctgaatcctcactaattcacttttgaaaagttcttaatgaacagttttattcttataccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttctttgttacccttgacccacgctgtacaagtaacatccaagagcccattctacaagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtcg

SEQ ID NO: 84 - DNA, 882 bp, Homo sapiens
caacctctgtattgggttacagtcaacctattggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggttgcttaaccatgatttttgtttttttttaccaagtcttaccagtgattatttacgtgtttccatgtttctcacttgggctgtattaaaaaaacctccattttgaaacatctacgttgtacagaagcccatgtctttatgtctccagacaaaaaaagctttaaattaattaatgtcgcctctgaggtgcacttcacggcagggctggcaaagaatgggggcgctcaataatcattttgcacaatgtgccttgtctgtgcaacttttgaactgcctttagttggccaaaatttttcaccggcgcacgcttgctggaccaacccggaaatcggatttgcaattcgcagtgtcccccttctctgcagggaatgttctcccactctcgcaaaagggtcgtgcgagacgacaacatactggggcaagcagcaagccgtcacggcaggccacaacacagggtgcggtgtctcgtcattcacaacgcgccctcacagtcttgctgg

SEQ ID NO: 85 - DNA, 1621 bp, Homo sapiens
gcggcaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaa

SEQ ID NO: 86 - DNA, 570 bp, Homo sapiens
  misc_feature (499)..(499): n is a, c, g, or t
ctttctttaactaggttataagcatattaaataagccaggtaaactccaagcaccttactttcttccatataaacacagctttccttttgccgcaagcatctgatgacgactgggcctacatacgtaaaaacagattatagcacatctggacctggttgacataatgaggcatccagattggttcatgattatttttgcagctacacatttctcaatctaaaaaaataggctacagcagcccaaattcactgtctcagccttggtggggcataatattttggaatggcaagtgccaaaaaatttaaatgtactgggcaagcctgctttgtgtagttgactctaatgcctttaaaaatactggcatgattttttatattcaagaagtacagctatgaaattttaaaataaaattacatgaagttttttaatattccaaaccacaaaacagatctgctatgtggtagactttttaatagcctattggagatttaactctgntacgccaacatcttctttaaagtcatgctttgaatttgggctccaaataattaattagaagggggggaaat

SEQ ID NO: 87 - DNA, 3124 bp, Homo sapiens
ggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaaaaaaaaaaaaaaaaaaaaaa

SEQ ID NO: 88 - DNA, 8568 bp, Homo sapiens
cctcgctccctctccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcactcatgcacctgcctgggtcacagggaatgccacaaccccaccaatgcctgaacaggggattgcagagatacaggaagaacaagtgaccccctccaccgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggcaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacaaaaaaaaaaaaaaa

SEQ ID NO: 89 - DNA, 2104 bp, Homo sapiens
acgtagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacagaaaaaaaaaaaaaaaaaaaaa

SEQ ID NO: 90 - DNA, 741 bp, Homo sapiens
  misc_feature (492)..(492): n is a, c, g, or t
  misc_feature (652)..(652): n is a, c, g, or t
  misc_feature (696)..(696): n is a, c, g, or t
  misc_feature (707)..(707): n is a, c, g, or t
tttgcttttgtttcttctggtcccatcactgggacctaaaagaagctcacatgtggtctctggaaatgctgaagctgtggactgtagacattattttcagtccttgtcctggtggctgcataccagatgctgctccttccctgtgtgtggccagctgtacacagtgacatgctcccaaggccgcggcacaggcggtgatgggaactcctccccgggccagcctctcaggctgcagccccacggcaccctgaggccctcatctctgctcggcagctaaaacatctccttcttcgatgctctgcaactgcagcctctggctcacaagagttctgctgcctcggcggcccccgaagccgccccccgggacagtccgtgctgtaaccaagacccctggcaaagcctcctccccaaataagttgattttggcttcggcctcaatggctttggccaagcttgctgcgtaactgtccaaggacttgtgtacttcagctntcacatgaagaatcgagttcttggcagcttctttgatttgttccacttcatcctcaaatgtcaccgagctccttctctttggtgggcaagtgcagtgagaagggagggtgtcatcagacgtgtgtcctcaagcagcatcatatctgtccctgagtcctgngagcagctgaaaccagtgtcccccgtgctgctgctgtgccccangggctgtccgnctgccatgagcgcaatgagtgtgggacaggcccc

SEQ ID NO: 91 - DNA, 586 bp, Homo sapiens
agttaaaagggtgggagcgtccgggggcccatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaa

SEQ ID NO: 92 - DNA, 1840 bp, Homo sapiens
gcgcacactctcctaagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggcgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggtcgtctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactcttacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatatgaggagattgctcagaggagcagggctgaggctgagtcctggtaccagacaaagtacgaggagctgcagatcacagcaggcagacatggggacgacctgcgcaacaccaagcaggagattgctgagatcaaccgcatgatccagaggctgagatctgagatcgaccacgtcaagaagcagtgtgccaacctacaggccgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggacgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactgaagtcgtgccgccagctctcagtcccacagctctcaggcccctctctggcagcagagccctctcctcaggttgcttgtcctcccctggcctccagtctcccctgccctc

SEQ ID NO: 93 - DNA, 1548 bp, Homo sapiens
aatgaaatgtgtacagcttgccgtgttctgactgtacccttccctcttccatgtctgagaatctccgtgtattttaagaatgtgtgaggagagggtggcgattcatgtttcaatgagcctcttttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggatttttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacctttaaacagaacaacctctttaaaaacttctcttgtgtttaacactttcttcatgccaacgaaacagggtaaacatgctcaaaacattaacagtctaaacagatatccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtgaaaaaaaaaaaaaaaaaaaa

SEQ ID NO: 94 - DNA, 543 bp, Homo sapiens
  misc_feature (101)..(101): n is a, c, g, or t
  misc_feature (268)..(268): n is a, c, g, or t
  misc_feature (273)..(273): n is a, c, g, or t
  misc_feature (430)..(430): n is a, c, g, or t
  misc_feature (450)..(450): n is a, c, g, or t
  misc_feature (455)..(455): n is a, c, g, or t
  misc_feature (474)..(474): n is a, c, g, or t
  misc_feature (508)..(508): n is a, c, g, or t
  misc_feature (520)..(520): n is a, c, g, or t
  misc_feature (528)..(528): n is a, c, g, or t
  misc_feature (536)..(536): n is a, c, g, or t
aaaatttatcggttccgacttaaaaccatcaagtctggtcagaatcaactcagtctagctgatgcaaaatcatatgcattcaaaaagcagtctttaccganatgcctttacaaaccttggaatccagcaccttcttaaggcaaagtttcatggcagcagggaagtgaactaataattttcatttaccacatcttggtgtctttgaaaaaatactttatggcacaaacctgtttttgtctctccttatgtctccacttccttcaagtanactanatgctacaggcaatttctcatttatgccaccatgcagtctcaatccattttcaacttgctctacatacctaaaatcttccactactacacaaacctcagacacactgcaatctccacagcatgtgtgctccacagcatgtgtgctccacacttccanctgggcctgggttccttganttgtnaatggcagtgtttttttcncctatgtttgaaaaaaaacaaaaaaaaacccggnccttgggtaacncccccggngcctccantttatcc

SEQ ID NO: 95 - DNA, 2100 bp, Homo sapiens
ctgcccatccgtcccgccccctagacgcacgtccgctcgcccggcgcccgagccagtccgcgcgcacgccgtctgcgccccgaaagccccgccccaaggcgcgcccgcccaccgctctccacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgctgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtg

SEQ ID NO: 96 - DNA, 1677 bp, Homo sapiens
cccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgtttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtga

SEQ ID NO: 97 - DNA, 3923 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtgaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaa

SEQ ID NO: 98 - DNA, 2063 bp, Homo sapiens
cagcagagaaacaggagtctgcagaagatgcctgcaaatcagcccaggactgccaggtctggcttgaaaggaaaataggggataaccagactgggcgcagatgctaagaaaccctctggttggcagggttcccagccccagggcacccacggcagggagaggggtagctggggttgggcttgccttttctcctgcccactaccattttgaccctcctctggggaacttaggacaggtgacccaccttcaaggcagctcccagagttccatttgatgtccttaggggctgacagattgtcagggaagaagagaggagcttctagaatgcagccagctcctcagtaaagcaagtccccctcaggctctgagcacccccccaacccgcccccaccacacacacacatacacacataccttgctgggatgggagaggaccctgtccaaaggcctcccccagtgggaggaagctcatctgacaccacgccagagagccaaagtgtcttttcttcctcaaagtgaggacagcgaacttgctgggcccttcaagtataaataaagcatttgggatccccgccccacccctgacctttttgccctgggaggcacaggctgagctttgaccttgggtgcctaggccttcctgtgtgagtacactcctttctgcacgggataagattttatgcaaataattacttagtactcctctgaccttttctgtttgtaaaacaatgcatattcattgtgaaaacttggggagggcaatctggaagtgcagagaaaacctacaccgcgcagcttgagatgtaagagctctatggacagccctctcatcactggtcagcatttctaaaaccaaactaggatcgtaggttattgttccttattcttatttcttaaagtctcctgggaagtggcttttttttttttttctggcatctgatccagagtcccggagagggaggtgcagagctgctgctgggtggggaaccctaggggcaggtggagccctggctccctgtccctgagaagctgtgtcctctcagaactgtggcctaggctttggactttcagagcttgcctctgtggtatgaggagcggggagagactgattccaagagccctcctgacctcaatgacagtgacttaaatttccatatatactaaagtcacctctgctgattttctgtccatctaggtcaagcgtaattatttgcagtccctgtgcctgtgactcccatagccctgggagggggctgtcatcctatctgtgccacaaccagagttcatatgtccttttgccctccccattacagaccatcctacaattggtcctggaatcacacctgtcctgacgcctggacattgacctgcccatctcccggaactggcgttaggtgctgttgcctcactgcagttcttccctggcaacaactgacctgtgcttattttctctcctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggtgagcagggccctcgggtgggagggaggcagggggagacacagctgctgccctgcaccagggagcagtaccaccactacccccgtagctctcctgagcccatgccggcatgttttgtgagcttctctgtattcttctgcgccaccgtcccttgcgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccctttaagaaatgttatttttaatcaaaataaattctccctttcctgtgaaaaaaaaaaaaaaaaa

SEQ ID NO: 99 - DNA, 4797 bp, Homo sapiens
  misc_feature (135)..(135): n is a, c, g, or t
  misc_feature (501)..(501): n is a, c, g, or t
  misc_feature (4421)..(4421): n is a, c, g, or t
  misc_feature (4467)..(4468): n is a, c, g, or t
  misc_feature (4698)..(4698): n is a, c, g, or t
cctgggaccaaagtgctgcccagagctgagggtcctggagccacatgagaaggcttctccctgtgtacctgtgcagcacagggtagggtgagtccactcagctgtctaggagaggacccaggagcagcagagacncgccaagcctttactcataccatattctgatccttttccagcaaattgtggctactaatttgccccctgaagatcaagatggctctggggatgactctgacaacttctccggctcaggtgcaggtgaggttgtcatgggggccccccccacccaagacggcaacaggtcatgcctgggggcagtggtcaggcagtctcctgtgtttactgagcatgtactgagtgcaccctgcctgccctgtctccacccagctggctccaaagggcaatgctgaggagaggaatggggtcgtgagctgctgttaaggagagctcatgcttggaggtgaggtgaaggctgtgagctccagaaggccccagggcgcnctgctgcacgcaggctcatattcactaggaatagctttactcactaagaaacctctggaacccccttcagaaggttatttgactcctgagcctctattttctcatctgcaaaatgggaataataccttgacctgataagcttgtggagctgtaaggcagcacagagccagctggggtgtagctcttccatccaagctcccttccttacttcccctttcctgtggggactgggggagagaagtccctgagctggaggtggtcagggaagcttcacagaggaggtggctcttgagtggacctcaggaagaggggtgagagagctaaggaaggaggctgaggtcatccctggggaagtgacctagcggaggcctgagagctgcaaggtaggatatctgttgttggaagtgtctgttgttggaagtgggggcctttttttcagggagggtggggccagagaagtgtgtgccctgggataagtaggataaccacagtagttatgcccctaagggatgcccaccccacccctgtggtcacagaaaagctttcccaggtggcctaggcacctgtctcgtggctccagagacaggctgcacctgacacacacaatggaaggacagctctccttgtccattttccaaggagcttagcctcagctgccttgtccaggtactagcctccctcatagcctgagcttggccagcccaggtgctctggagcctcccccgacccacccaacacactctgcttctggtcctccccaccccccacctccccaacacactctgcttctggtcctgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggtgagtggcctctgcattccttgggaaattgagtgggttggtcctaatgcctggcacttggcaggccctacacctgtgccctgcgcgatctcgtattcctcaccaggaagacagggcacaggggccgccttcccctacccccagggcctcgcagagcaggacagactaactatgagatcagagcagaagcacccttaaagatcacccaagagagggctcccaaactcacaatccaaacttgcagccctcgtcgaagagtgaacgttataccagtcattttatttatagcttcgtggatttacgcttacactaaatagtctgctattcatacaaaatgtgtgctttgtatcactttttgtgatatccatgccatggtccagccagggtccggagttgatgtggcaagaaggcctggctttcgggccctgtgcgatcctggtttgggtgcatctgagtgggtggtggcaaagatcagggaggcaggagctgcttctgggtctgtagtggagctggttgctgctgctggcggtgacctggccaacccaatctgcccctgccctcccacaggacttcacctttgaaacctcgggggagaatacggctgtagtggccgtggagcctgaccgccggaaccagtccccagtggatcagggggccacgggggcctcacagggcctcctggacaggaaagaggtgctgggaggtgagttttctttcaggggggtagtttggggtgaattgctgctgtggggtcagggtggggctgaccacagccaaggccactgctttgggagggtctgcacgagagcccaaggagccgctgagctgagctggccccgtctacctgccctaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtgggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtcactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagacttttttttttttttttaaactaggagaaccaaatctggaagccaaaatgtaggcttagtttgtgtgttgtctcttgagtttgtcgctcatgtgtgcaacagggtatggactatctgtctggtggccccgttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcaggctcacgcccgtcctcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagcccatcttctaaatggcaaaggaaggtggatggccccagcacagcttgacctgaggctgtggtcacagcggaggtgtggagccgaggcctaccccncagacaccttggacatcctcctcccacccggctgcagaggccagannccagcccagggtcctgcacttacttgcttatttgacaacgtttcagcgactccgttggccactccgagagtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtncccaagccagaggtgggttcatttgtgtaacgacaataaacggtacttgtcatttcgggcaacggctgctgtggtggtggttgagtctcttcttggcct

SEQ ID NO: 100 - DNA, 420 bp, Homo sapiens
gggcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggtggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattcca

SEQ ID NO: 101 - DNA, 728 bp, Homo sapiens
  misc_feature (556)..(556): n is a, c, g, or t
  misc_feature (714)..(714): n is a, c, g, or t
ttttacaaacgcgattttacttggtgagtcttttggctacatcactatatgctatttcaacctccttatcactgggacaggtattggtgaactcgtccctactgtatgcattagttaggtatctccagatgccagtcatttcttttggaatatcaaagttgcgatattttttggccaccaccttgacaatatgcagtttgggcagcaggttgcaatcagctaatgtcatttcattgccatccagaaatttacgtgtagaaaactttatgtcctccatactattttcatcaatttcatcagggagaggagaattcagatattcatccagtttctgcagggttttcaggagacccctctccagtgcttcattagcctctggccttgaattcttgatatatgcagagaatttggcaaagatgtccattccagcagtatttgattctgggtgttttggtgaaagctttaagtacttgggagggcataagacttcttcaagaaattcctcaatcttatttacatccgttttgacttcactgttgaaagttataaatggtgngtgggtcccgggagccaagttctgcaggtctgctggcttccttttcaggtcaacagtcgtcacactaaatacaactcctttgagccaaagaatcatgaagagcctctgggaaaagggcagtttcctatgcttcaccatcactgccagccttgacgaanagctcgatgagggg

SEQ ID NO: 102 - DNA, 873 bp, Homo sapiens
  misc_feature (7)..(7): n is a, c, g, or t
  misc_feature (284)..(284): n is a, c, g, or t
  misc_feature (441)..(441): n is a, c, g, or t
  misc_feature (448)..(448): n is a, c, g, or t
  misc_feature (563)..(563): n is a, c, g, or t
ttatatnaaaacaagtkttkkaattgcctactaagataatttctgtccatgmtttattataacctgcagaaacaacatgcacttctgtatttgaaaaaacaaaaactacggttcatttttctakatdktkcwkatattkcgcagcawttttaaacttggatcttctgttgacttcagatgtggttggtatcactgctcagatacagagttatgatgatcagtagaaaagtctctatttcacagcatgggtttctttagaaacaggctcctgtgcaaaggcagtncttttaccatgaacatctctagactgtgattattaaatatagtgataatatacatgggtttactgggatattgaaaaataaaagataatgaacccaatttagtaaatcaacataaatacaaaacagagcgaattagccctctacaactgagctcgtnctgcgtnttgagcttgggttctttctggaactgtctcaaaccttagtgggggaagtgaccttatccacagattgcttttcccagaggttccgcttgctggatacgtctcctggtctcaagtnagaaggtttgggagcaggtgacttgtttccatctggggttttagttagccattcattgatgcggctagaaacccctaccttcaagccagcagtttccttatttggtgtgcctgctgcagtgggggatgaaacacattccctttctcccacatactcttgatgttgcgtacaccttcagcaggaacaggaagatccgaggctgccggctttgtaggttttgcgctttttgttccctctattgcactggtatactgctccagtttgctgttaatcttggagactattgctgcttgatgggkcgatttgamac

SEQ ID NO: 103 - DNA, 661 bp, Homo sapiens
gcggccgctctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaaaagaagcctgctgtcaccgcagcccccaagaaaaagatgccctttcttgaattgcattttttaaaacaagaaagtttccccaccagtgaatgaaagtcttgtgactagtgctgaagcttattaatgctaagagcggccgc

SEQ ID NO: 104 - DNA, 5927 bp, Homo sapiens
gaaggcgaggcggggagagactgggaaacagagcagcaagagaaagggcgcacgctggggtcctcctggacccggcgtgtcctcctctccgccacccctttctctccctcccgacgctctagccccagacccgcgcctcctccccttcccctcccacgctgcccacttcccttcccctctacccctcgaaccctcctccccggttctgcgctcctccctccgccctccctccgcccgggctgcctcctccctcctcctccccgggaggcatcacttcgtcccgacccggaggaggacgcgagccccttgcgggcggtcatcacagcccagcctcggggctgccacagcgcgttgcgcctgtgcgccctcggtccccgcgtccactgagcgccgcgctcggggatggggcccggccggccggcccccgcgccctggcctcgtcacctgctgcgctgcgtcctgctcctcgggtgcctgcacctcggccgtcccggcgcccctggggacgccgccctcccggaacccaacgtcttcctcatcttcagccatggactgcagggctgcctggaggcccagggcgggcaggtcagagtcaccccggcttgcaataccagcctccctgcccagcgctggaagtgggtctcccgaaaccggctattcaacctgggtaccatgcagtgcctgggcacaggctggccaggcaccaacaccacggcctccctgggcatgtatgagtgtgaccgggaagcactgaatcttcgctggcattgtcgtacactgggtgaccagctgtccttgctcctgggggcccgcaccagcaacatatccaagcctggcacccttgagcgtggtgaccagacccgcagtggccagtggcgcatctacggcagcgaggaggacctatgtgctctgccctaccacgaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtaacgactgcgagaccttctgggacaaggaccagctgactgacagctgctaccagtttaacttccagtccacgctgtcgtggagggaggcctgggccagctgcgagcagcagggtgcggatctgctgagcatcacggagatccacgagcagacctacatcaacggcctcctcactgggtacagctccaccctgtggatcggcttgaatgacttggacacgagcggaggctggcagtggtcggacaactcgcccctcaagtacctcaactgggagagtgaccagccggacaaccccagtgaggagaactgtggagtgatccgcactgagtcctcgggcggctggcagaaccgtgactgcagcatcgcgctgccctatgtgtgcaagaagaagcccaacgccacggccgagcccacccctccagacaggtgggccaatgtgaaggtggagtgcgagccgagctggcagcccttccagggccactgctaccgcctgcaggccgagaagcgcagctggcaggagtccaagaaggcatgtttacggggcggtggcgacctggtcagcatccacagcatggcggagctggaattcatcaccaagcagatcaagcaagaggtggaggagctgtggatcggcctcaacgatttgaaactgcagatgaattttgagtggtctgacgggagccttgtgagcttcacccactggcacccctttgagcccaacaacttccgggacagtctggaggactgtgtcaccatctggggcccggaaggccgctggaacgacagtccctgtaaccagtccttgccatccatctgcaagaaggcaggccagctgagccagggggccgccgaggaggaccatggctgccggaagggttggacgtggcacagcccatcctgctactggctgggagaagaccaagtgacctacagtgaggcccggcgcctgtgcactgaccatggctctcagctggtcaccatcaccaacaggttcgagcaggccttcgtcagcagcctcatctacaactgggagggcgagtacttctggacggccctgcaggacctcaacagcaccggctccttcttctggctcagtggggatgaagtcatgtacacccactggaaccgggaccagcccgggtacagccgtgggggctgcgtggcgctggccactggcagcgccatggggctgtgggaggtgaagaactgtacctcgttccgggcccgctacatctgccggcagagcctgggcactccagtgacgccggagctgccggggccagatcccacgcccagcctcactggctcctgtccccagggctgggcctcggacaccaaactccggtattgctataaggtgttcagctcagagcggctgcaggacaagaagagctgggtccaggcccagggggcctgccaggagctgggggcccagctgctgagcctggccagctacgaggaggagcactttgtggccaacatgctcaacaagatcttcggtgaatcagaacccgagatccacgagcagcactggttctggatcggcctgaaccgtcgggatcccagagggggtcagagttggcgctggagcgacggcgtagggttctcttaccacaatttcgaccggagccggcacgacgacgacgacatccgaggctgtgcggtgctggacctggcctccctgcagtgggtggccatgcagtgcgacacacagctggactggatctgcaagatccccagaggtacggacgtgcgggagcccgacgacagccctcaaggccgacgggaatggctgcgcttccaggaggccgagtacaagttctttgagcaccactccacgtgggcgcaggcgcagcgcatctgcacgtggttccaggccgagctgacctccgtgcacagccaggcggagctagacttcctgagccacaacttgcagaagttctcccgggcccaggagcagcactggtggatcggcctgcacacctctgagagcgatgggcgcttcagatggacagatggttccattataaacttcatctcctgggcaccaggcaaacctcggcctgtcggcaaggacaagaagtgcgtgtacatgacagccagccgagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcggtggtcctgcacagcccctcagcccacttcactggccgctgggacgatcggagctgcacggaggagacccatggcttcatctgccagaagggcacggacccctccctgagcccgtccccagcagcgctgccccccgccccgggcactgagctctcctacctcaacggcaccttccggctgcttcagaagccgctgcgctggcacgatgccctcctgctgtgtgagagccacaatgccagcctggcctacgtgcccgacccctacacccaggccttcctcacgcaggctgcccgagggctgcgcacgccgctctggattgggctggctggcgaggagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgttttt

SEQ ID NO: 105 - DNA, 5809 bp, Homo sapiens
gtgaccacggaccaggcagtctctaatgaataggcaaggccacaacctccattctcccagaaaagaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgaggagatttgcaccctagttatcgctgagactttccctgaagatgcagggatctttacatgttcagcaagaaatgattatggatcagcaaccagcactgcccagctggttgtcacctcagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacatttctcgacattaatagtgaaccacaccaggagaacaaatacccaacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaatattcagtttta

SEQ ID NO: 106 - DNA, 759 bp, Homo sapiens
  misc_feature (689)..(689): n is a, c, g, or t
  misc_feature (703)..(703): n is a, c, g, or t
ttttttttttttaggagtgtggtttttttaataccatctgtgccaagcaatatcaaagttgtccatactctccaagtttgtcctatttttaatagacaatattaaaaattttttaagtgtgtgctgataaagagactagtcacacctctgaggggatttaaaaatgagaagccacataaattctcttccttaaaaaacagccatttcaaaagattttctttaatatcataaaatattttcatggacaagtgagctagcaaacacacatgcaccaatgtgccttttgacaagagtaccccctaccccgactcccacaccaaaatggacatgagattggagaaatgaatacagcagatggaacagatagaagaaaaaaaaatcagtaaaaaggatggaatataactttgtgcttggttattttcctatgtcgcaacaaaacaagacatttcggtgcaaatagttaatctttcctctttttttccatttgtctggtggagaaaaaatactttttctataataaaatatgtagttttttggtttttaacgtaacttttttttcttttttgcagaaaataattttgtaaactgtcacttcgcgggcagggaggatcgatgtcacgtgggccccagctcacccgggtggaggctgggagctgaaaccgaacccaggcaggagatgggcgaccggngaggtgcaaggcanggcacggcgcacaagacgagggcgcccgggccggggtgatttaaggtactctgccg

SEQ ID NO: 107 - DNA, 2095 bp, Homo sapiens
ccgagggtagcttgagcgcggcggcggcgttgttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatcttttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgggctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaaggaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccataatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcaaaaaaaaaaaaaaaaaaa

SEQ ID NO: 108 - DNA, 1512 bp, Homo sapiens
ctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggagcagccgccccatctgccccacagtctccggcctctccagcctcagccccctgcttcagtcccttccccatgcttccttgcctgatgacaataaagcttgttgactcagctaaaaaaaaaaaaaaa

SEQ ID NO: 109 - DNA, 10531 bp, Homo sapiens
taggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagcgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactacgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtcttccagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcctggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccagagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggt

SEQ ID NO: 110 - DNA, 1550 bp, Homo sapiens
gcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtcttttttttctcccactgttgtaaataacttttaatggccaaaccccagatttgtacttttttttttttctaactgctaaaaccattctcttccacctggttttactgtaacatttggaaaaggaataaatgtcgtccctttaaaaaaaaaaaaaaaa

SEQ ID NO: 111 - DNA, 1633 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcctccgccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaagcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcct

SEQ ID NO: 112 - DNA, 1968 bp, Homo sapiens
gaggaggaggaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaaaaaaaaaaaaaaaaaaaaaaaaaaaaaaaaaaaaaaaaaaaaaaaaaaaaaaaaa

SEQ ID NO: 113 - DNA, 3935 bp, Homo sapiens
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctacatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 114 - DNA, 2722 bp, Homo sapiens
gggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaatccgggttgcatttaaaaaaaaaaaaaaaaa

SEQ ID NO: 115 - DNA, 817 bp, Homo sapiens
  misc_feature (794)..(794): n is a, c, g, or t
tttggcagtggaaaatgcttcagtactttattgaaagaaagcaataaataatactgtgataaaaatagttcaaaagtagactgtacatactttgttacataatcaggaagttgacaaaagattaatagaaaaacagaacagtaacaatgaattgtacaagtaaattaaaagcagaaaccaactgaaaagacaggctgcctctgtctctggatctgctgcacaataaataccacgccatggtctgacacactttgctggcttgttaatatgccatttaaaaagtaaaagccacatctgcaacttacacaatccaaaatggctagagcatcaaagtctaaaaatgtcccactaggttcgttctttaaacatgtttacaaacaaatgtaaaaagatgatttacataagaaaaataaggcctttattagagctgcactgcactgctttctgggtctcctgccttcatccactgtgtgcgccgacttgcaggatgagagcgtggtgctggtggcggccctaaggggagccacatgggtgtctctccacccgctcccaggagcaggagggcagggaagagggtgcaggggctagactggtccccaggttacccccatcccgagtctctccagctgggagaactgctcccagctcacagtctcagccactgaagacaagctccccaaattccagagactggctaggaaagcgttaaccgtgctaggggctctctaatgttgtgaaatgtttcagtccacatcttattaggggccgatatttaacaccagccattttaatcngttcatgctgcgaataaagctct

SEQ ID NO: 116 - DNA, 865 bp, Homo sapiens
ctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcctggatgcccacccctgctgccgccactggctgtgcctcccccgccacctgtgtgttcttttgatacatttatcttctgtttttctcaaataaagttcaaagcaaccacctgtaaaaaaaaaaaaaaaaaa

SEQ ID NO: 117 - DNA, 5590 bp, Homo sapiens
ctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtatggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtatacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttatttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaattttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatctgactttgtaaattctgatttcttttcaccattcgtacataatactgaaccacttgtagatttgattttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaac

SEQ ID NO: 118 - DNA, 1151 bp, Homo sapiens
ccgggatcccgcccgcacactcgcgcacactcgcgctcgggcgcacacggagcagggaccggcgcccggagcgagccagvgagcggctaaccggggacccaccgcgcggascagcctagctgccagcgagcccaacccgcgacgacccacgcccctgagccccgcagccgacccctgccggccggtgtccccaccgccatccctgacccatggcgctgaagaggattcagaaagaattgagtgatctacagcgcgatccacctgctcactgttcagctggacctgtgggagatgacttgttccactggcaagccactattatggggcctcctgatagcgcatatcaaggtggagtcttctttctcactgtacattttccgacagattatccttttaaaccaccaaagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaaatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtawttttttactgtatagactaaatatattctatttacatgtatgtcaactcattacttttttcctgtgaacagtattga

SEQ ID NO: 119 - DNA, 2707 bp, Homo sapiens
aaaaaaaaaaaaaaaaaaattcaggtccctgcaccgcactccgctcggaccccaggccgccggtgctgtcgctactcaagtgagtcccgcggtgcccctcccgccgcgccgcccgtcgggcatggactcgggccgggacttcctgaccctgcacggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggaggcggcagggcctgcgctggccctctccctcattgagcgctacgagcccagcgagactgccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagattaaaaaaaaaaaaaaaaaaaaaaaaaaaaaaaaaaaaaaaa

SEQ ID NO: 120 - DNA, 4312 bp, Homo sapiens
ctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtg

SEQ ID NO: 121 - DNA, 1471 bp, Homo sapiens
gtggccgcgcaggaggacggagccctaaccgcaacccgcgccgcgccgcgccgatttgatttgtatccactgtcaccagcactgctcacttaggactttctggatccagacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcatacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaaaaaaaaaaaaaaaaaaa

SEQ ID NO: 122 - DNA, 617 bp, Homo sapiens
ttttttgtatttttaatagagacagggcctctccatgttggtcaggttggtctcgaactcccgaccccaggtgatccacctacctcgacctcccaaactgctgggattacaggcgtgacaccgcgcccggcctgtcctggcccacttctagctagttatatatgcttgggtgagtcacgccctcctctgtcagttttccttaatgaggggattgactcgtttagcaacttacaagtgttttctcccactgaagagcaagctggaccaatacgttctgcagctaaaatcaaacaagggtctctccctagacccttgtaaaataacaacagcaataataattaatgtacagaagtttcacaatgtaagttctccccccataaatatctccaaatcagtggtacctgctaccctgtatattagactataatacaaatggagtctgagtctgaaaacaactcatatctaataaatttaagattaagcgatatatatgctattctgcagtaaggaacgtggctttcagatgtttttccacctgaagaattctgagagacatggggccaggtggacaccaaggctcttgcagtgtgaagtctgattcctctctgggttttcag

SEQ ID NO: 123 - DNA, 4490 bp, Homo sapiens
gcggtgtcctgcgcgtcttcgggtcagtacggggggccgcgtcgtagggactcactggcggtgcgcgacctgggctggctccgggggtggcgggcgcagctgctgtgacagcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgtttttcagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggcagtcctgcgttccctggagtaactgtacgtatctgcctttgctgggaagactgtggggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcctgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgtgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaaaaaaaaaaaaaaaaaaaaaaaaaa

SEQ ID NO: 124 - DNA, 906 bp, Homo sapiens
tacactagaaaggggaaataaattaaagtacacaagtccaagtctaaaactttagtacttttccatgcagatttgtgcacatgtgagagggtgtccagttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggcttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaatataaaaaaaaaaaaaagggggccgtcggggatttaaaatagggcgaagaaaaaaaatttttttcagccttagttgtttttgccggggggctttggagcaagaaagtgggttgggggggtaattggcctggatgtagcctgggggtggtggattcctccggtataaattgaccccaggatgattgttcttccctcagtaaacgtatagttcaaaaatcgagagtgatgcaaggtaaattgttcaacgggatgaaaggtggtacaaaaaagggggggataatactagggcatggacgtttaaggcatgggtaaagggggaaatgacgtgtgggattgggtagacacacgtattttttgtggtttttattttataggaggc

SEQ ID NO: 125 - DNA, 567 bp, Homo sapiens
ttacgaaacaaggctgccttttaattgctatcagatattcggatatcccgtctgatgtcagcaaggcccccgcgccccgccggaacccgcagggatggagcagcaccgccgcctgactgcacagaagggctggggcagggtcgctgtgcctctcggcctccttgctgccaccgtctcttagcctcggggcgcctggtgcaccgtctcctcttcgggtcagcccagcctctggcggccctcggaaggaggggaggcaggggtcgggggggtgagccggaggcgggggccccgtcgcgcacgcatgcagacttgccctgtgttggcttcgtttgttctcctcctttgctaaagtgatcagatagtcctgtgaagcagctgccagccaggtggacagggcagcggtgctgggatgccgcccgtgggctcctcggacatcctgaggccccgccctacttctgtatctggaacaggaagagccgcaggttgatgttcttggcagccagcagcttgttgcactccacggagtcaatgatgggcagtggcacgtagtccgtctcgttgctctcg

SEQ ID NO: 126 - DNA, 4602 bp, Homo sapiens
ggaggtgtcgcgccggggaacttcctggttcccgggctcggcttcgccgggatcctcttggaagggaaacaatggggcggagggcactgcggtagccgccgccgccgccgcgccgcgccgcgccggatctgctcggccgcccgggaccgccagctctgtccgctgcccacagcctagcagtcgggaccgtactgaggacatgtattcctctgagaaaccttggacagcagattttggtttaatatctgattgggacaacattcagacccatttccagtcatgaattcagaccaggatgtagcactcaaacttgcccaggagcgagctgaaatagttgctaaatatgacagaggacgagaaggtgcagagattgaaccttgggaagatgctgattaccttgtttacaaagtcacagatagatttggctttttacatgaggaggagctcccagatcataatgtggctgtggaacggcaaaagcacctggaaattgaaagaactaccaaatggctgaaaatgctgaaaggatgggaaaaatacaagaacactgaaaagtttcataggcgaatttacaaaggaataccactccagctcagaggtgaagtctgggccctccttcttgagatccctaaaatgaaagaagaaacaagggacctgtatagtaaattaaaacacagagcacggggctgttcacctgacatcagacaaatagacctggatgtcaaccgcacatttcgggaccacattatgtttagagacagatatggtgttaagcaacaatccttattccatgtgcttgctgcctattctatttataacacggaagtcgggtattgtcaggggatgagccagatcacagctttactcctcatgtatatgaacgaggaagatgccttctgggccctggtcaaactcttctcaggccctaaacatgccatgcatggcttttttgtccaaggttttcctaaactcttgaggtttcaagaacatcatgaaaaaatactgaacaaatttctgtccaagcttaagcaacacttggattctcaagaaatctacacaagtttttacacaatgaaatggttttttcagtgtttccttgatcgtactccctttacactaaacctcagaatatgggatatctacatctttgaaggagaacgagttcttactgctatgtcttacaccatcttaaaattacacaaaaaacatctaatgaaattgtccatggaagaacttgtagaattttttcaggagaccctggcaaaggattttttctttgaagatgattttgtgatagagcaacttcagatttctatgacagaactaaagcgggcaaagttagaccttccagaacctggtaaagaggatgaatatccaaagaagcccttggggcagcttccacctgaacttcagtcttggggcgtccatcacttgagcaacggacagaggagcgtgggccggccgagcccgctggccagcggcaggagggagagcggggcgccccacaggaggcacgagcactccccgcacccccagagcaggaccgggacgcccgagagagcacagccgccaagacggaaatcggtggaggaggagagcaaaaagcttaaagatgaggcagattttcaaagaaaactcccatcgggtccacaggacagttccaggcaatataatcacgcagctgccaaccaaaatagcaacgccacttcaaatatcaggaaggagtttgtgcccaaatggaataaaccgtcagacgtctcagctacagagagaactgccaaatacaccatggaaggcaaaggtcgagcagcgcaccccgcgctcgcagttaccgtcccaggtcctgccgaggtgcgggtgtcaaacgtgcggccaaagatgaaggccctggatgctgaggacgggaagcggggctccactgcatcgcagtacgacaacgtgccaggcccggagctggacagcggcgcttccgtggaggaggcgctggaaagggcttactcccagagcccccggcatgccctttaccctcccagcccgagaaagcacgctgagccaagttctagtccatcaaaagtatccaacaagtttacttttaaagtacagcctccaagtcatgcacgatatccgtcccagctagatggggaagcccgagggctagctcatcccccctcctacagcaatccccccgtttaccacggaaactctcccaaacacttccctactgccaacagcagctttgcttctccacagtttagccctgggactcaactgaatccttccaggagacctcatggttctactctttccgtcagtgcttctccggagaaatcttacagccgcccaagcccccttgtactgccgtctagtcgaatagaagtcctccctgttgacactggtgctgggggatattcgggcaattcagggtcaccaaagaatggaaaattgatcattccaccagtggattacttgccagataacagaacatggtcagaagttagttatacatacagacctgagacgcagggacaatcatggacccgagatgctagccgtggcaatttaccaaaatactcagcctttcaactcgcaccctttcaggaccatggcctccctgcagtttctgtagatagtcccgtgagatataaagcttcaccggccgcagaagatgccagtccatctggatatccatattcagggcccccgcctccagcctaccactacaggaatcgggacgggctttccatccaagagtcagtgttgctgtgagatttgacgtgtacttgctaaagacgagagagaaaccacgtgaaacctacattgctatgttcataattgccaaagcagtatttatactattgtaaacaactcgcacatctctcctgtctgttagtaataagaatacagggaaatgtcttcagccccacgtagatgctgcttaagatgagcgtttcaattgcatcatcactgacctgtagaatttaacccggaaacatcgcaatagcatttagggatgcacgcacagtggtaatttattactcagttccggttatgtttttctccaaaacctgaacatttttactctgttggctcattctattttgactaatgttacaaagtactgaaaaaactgtagaatagatatttttaaggctatatgtagtgtatgtgtcttttaatagatataggcatctgttcatccacatttgaacacagagctaaagaaacgttttttaaaaaactacttttaatccagatccatggaataatatgtaattcttgttttccttgtcttttagtccagtttttctttttccctctcatatatttgtaacctgggtcctaaactgactgaagagtttgtcctgactttattaattgcagtctcacagaatgctcatcattctccttcagctgttgccattttctttcaatctgaaaattaaagacattggagagaaaggctaaccacttaatggtgcttaaaaatcggggcacttaaaataagtttacggccaaaggtgcagcagtgcttatcacatccacatactaagagattggtcttagtgcgtttgtgccctttgttctggtctgactcttgcgaatctcagagcaggagaagttgcagcttactgatccctcagtgctcacagtactcatgtggggcagccacactaactgcattagcagtgtggttacttctttcttctgcctcgactcacatggcttctccccacgaaggtcccagggtggccatttatacaatccatttctgtcctctttatggaatgtagtcgacggatattgctgcacctcatcaggccattacattgtccatgttaaaattataaaaatgatcctagtttttcataggagtctaggattttgatcttttaaaaaatacagtgtgatttcatgcttttgaacatctttttttttttcattgaaacaaattcaagttcttggcttaaaaaaaaattagtgatgtctttaaaaaatattctgttacactacagataccaaaacactgacaaagatttaggcactccaagagagtatgacttcgtgtttaattggggagcttgttttcaacattgcttatatttgaatagtagaaaacccgacattgatgtttcttcctgttgcaaggtggggctttaaactttcaaggtacaaaagtatgtcttttaaaatggaagtaacgtttgtttagctagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttttatatatatatatatatatatgcaaaaaatatatatatacacacaagc

SEQ ID NO: 127 - DNA, 1735 bp, Homo sapiens
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaaaaaaaaaaaaaaaaaaaaaaaaaaaaaaa

SEQ ID NO: 128 - DNA, 1569 bp, Homo sapiens
caaaatctcaaccatgatcttgagatggcaaaggttttaaatacgttttggaaatatactcattggtatatttcttttgagaaggctgaaatgtagctggggacagcaggttgatcacaagggacgatgatatgaggtaagcacacaagagctatggacaagacaaggtctaaaggattttgaatacaaagcagaaatatttcgaccttctcatttctggggtgggagtggggagtgttcattaagtacatatgacaagagggagtgtggggagaaggtgaaacagtagactacatttatggattaagtagggaatgtgaacaaagatgttaaagtcatggcgatccggtagacagattacacagaaggggaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtgctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaagcaagcccatgtcagggcgatcctggttcaaatgtgccatttcccgggttgatgctgccacactttgtagagagtttagcaacacagtgtgcttagtcagtgtaggaatcctcactaaagcagaagaagttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattttaggacattttctaaa

SEQ ID NO: 129 - DNA, 1444 bp, Homo sapiens
acaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttgcacccaagtccgcatctgtgtgtatcatcaataaagttgtgtgctttgattggcgaaaaaaaaaaaaaaaaaaaaa

SEQ ID NO: 130 - DNA, 2315 bp, Homo sapiens
cctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcaaaaaaaaaaa

SEQ ID NO: 131 - DNA, 796 bp, Homo sapiens
cggacgcgtgggcggctactggttcctaaagctactgcaggcatgaaacagatgcggctggaaggctggtgctgccagatggacaaggagaccaaagagaacaacctctctgaagaagtcttaggaaaacgtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcatgcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaacgaaacgattataaatcattaaaaacacaaaaactaagtgcgaacggaacagagtatctcaaaccttggtatggtaatcctgctagagacctgagccaactttcaatggcgcatacagggctcaaattggcattaagggacctccagtaaaggtagagatttctcacaacaattaaaaaatagaaactgacat

SEQ ID NO: 132 - DNA, 5979 bp, Homo sapiens
gaagaaatcgagaaaacaagaaagcacgaaagcaagcaagcaagaaagcaagcaagaaagaaacaaaagaaagaaagaaagaaagaaaacaggaaagcaagaaagcacgaaagcaagcaagcaagcaagaaagcaagcaagaaagaaacaaaagaaagaaagaaagaaagaaagaaaaagaaaacaggaaagcaagaaagcacgaaagcaagcaagcaagcaagaaagcaagcatgaaagaaacgaaagaaagaaagaaagcaagaaaacgggaaagcaagaaagcacgaaagcaagcaagcaagcgagcgagagagagagagagagagagagagagagagagagagagagagagagaggctgggcgcggtggctcacgcctgtcatcccagcactttgggaggctaaggcaggcggaccacctgaggttgggagtgggagaccagcctgaccaacatggaaaaacaccgtctctactaaaagtacaaacatcagccaggcacggtggcccatgcctgtaatcccagctaatcaggaggctgaggcaggagaatcgcttgaacctgggaggcggagggtgcggtgagccgagatcgcaccattgccctctagcctgggcaacaagagtgaaactctgtctcaaaaaaaaaaagaagaagaagaagaagaagaagaagaagaagaagaagaagaagaagaagaagaagaagaagaagagaaagtaataaagaaagaaagaaagaaaaggcaaggccaggcaagtccaggcaaggcaaatctacctgctttcactacatctggggagaatcaggaaagtccccaacaacaacaaggcctaaagtggagctgccatctgtcaaacccgagcggaagagtccacgcgggttaaagacacgaagaaagacaaggaaacccctgaccaaggagaagaacaatcgggcccagccagggtctgtctcccggggttgtctgggcaaccagggagggcgggcctccgagactccgtctcgaaacatcaatcacgataataacataaaatgaagttaaaaaaagaaatcacgcataattcctaacgtgtttgaggcctcgaaaggcgagaggcgtacgtgtatgtcacggtggggttgttctgttttgttgtttttttcttttttcttttcttctttttccccagaaactcactttttaattattttgttgcgtttcattttcattttcattttttggagacggagtctcgctctgtcgcccaggctgggttgcagtggcgcgatctcggctcactgcaacctccgcctcccaggttcaagcgattctcctgcctcagctcggcctcccgagtagctgggattacagacagtacagcacagcacagcgcccggctaatgttgtgtattgtgagtagagacggggtttcaccatactggccctgttggtctgaccgcctcttgatccaccggccttggcctcccaaagtgaggggatgacaggcttgagccaccgcgcagggcccatttatttattttattttatttatttattttaatttatgtatgtatgtatgtatgtatgtatgtatttatttatgtatttatttttgagacggagtttcgctcttgttgctcagactggagtgcgagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttcaatagaaaaaacttgacatttttttatcaacgatgaacaacaaggtcccatagcatttgataacgtggagggcctcttcttccctgcggtcagcctgaacaggaacgtgcaggtcacgctgcacaccgggctcccagtccccgacttctactccagcagagcatcaatagcctaaggatgtgccgtggaggcgccagctgcctgttcttacctccgcctgcgagagccacagcaaggagctcagccagccgtggtggggtgcagagttggcaggagtgggagaaggaggagagaaaagctggtcctctgcagtctttacacccacagctctgcccttttccctttcaacctctcctccgctgtcatgcctgcttccgcttccatgtccaacaattctaaccaacaaaggacctagacagcccaccaagtcacttggttcccactcccagattttgcttttatttaacttaattttttatgtaggtgagttatattttctttcttttctgatcaggttattggtgacttactggactggcaccgccaggagaaaattctcctgctaactttttttcttaagctttctgtcaaacaatgaggttgtagggggaggtagggaagaatgagctgaatttgtagcatacagcttacctgctagaatgttcttaccctcttacctctcctgtagcgttagctctgcagagctaagctttgggagaatgaatctatcactgagaagttttactactcattgaagcacaaaaatatccgctacacaggttcacatcagggtaggatcgttaggatggctctataattaggataggccagaaccctggccactgtataaaattggaaagtctctaagacacaggcaaaccaggggacttaatgatttggttcgtttatttaataaaagcttttaattgagaacctactattgaccaggcactgttcaagacactagaacattatgttctagacactgtggggacacagtggtgaacagacaggcatggtctctgcccttcggagcttatattccagtaggagaaaaagcaaaaataaaataattataaatggtcatatgtactagaaaggaaatgggcaagggtcaaagagactcatgggcaagatctttcaggcttcctagaatgatgctaaaaatccacacattctggccatagcaccagaaatgtaccaactcaatgccttttcagctgcactatttaattatggtacctgctgccactcatcacagagcccttcttggtagaaatgatgtcagcattcttatttgctgatgctgctatgataccacgccttaaaaattgacagttgaaaaaaaaaagagtgaccagagggcaaaggacccattctcagtaatgggagatcttgagttgcagtccacagcattcacattctcaggataaacatgcttgtctccatatatactatctgtgcctgttatgaatgaaaaatccatccactctgctgccattcacagcctaatcttctggagtagtccaaacaatgtttggaaaaacatgggactgtatgtcattactatgactgatagcagaataataatgcatcttacttctatatagagatagacttacataggttacccttgaaattcattagtttgtcataaagttttaggaaaggtaggacccggaaagaagttctaattagttgtctaaatatttttcagtgagccaagaaattcaccatgaaaaaacaagaataacaaatagaagggaagagataggatgggaaagctaacaaattaaagttttggcaaaaaggaatatatgtaaatagctaattatttacttttgtgcttactttatttagattatttctatcagttacaatctttttctagttaagtgtacctaatttatggaatgggtgctatcctgtttatgtgtgtcttggtttttcttggctacagaaaaactgttgcagggcaacactagtttgatatttgatttactctccaatgagactcaatggctgggccgtggtagactcatagttcctcttgttctttattaaattcatcctgctaattagatttctagtgacttgtaacatgtagtttacactgaattgcaattacagatgcatacaactactatactagaaaaaattgtcatttctgatgtgccaataaatgatttttatgagagaaaaaaaaaaaaaaaaaaaaaa

SEQ ID NO: 133 - DNA, 743 bp, Homo sapiens
  misc_feature (531)..(531): n is a, c, g, or t
  misc_feature (655)..(655): n is a, c, g, or t
  misc_feature (657)..(658): n is a, c, g, or t
  misc_feature (665)..(665): n is a, c, g, or t
  misc_feature (667)..(667): n is a, c, g, or t
  misc_feature (672)..(673): n is a, c, g, or t
  misc_feature (702)..(702): n is a, c, g, or t
  misc_feature (736)..(736): n is a, c, g, or t
tttggcatgccactaactattttttatttgcaactacatgatggcacacaattctcttaaacaacgacataaaatagatttccttgtatataaataacttacatacgctccataaagtaaattctcaaaggtgctagaacaaatcgtccacttctacagtgttctcgtatccaacagagttgatgcacaatatataaatactcaagtccaatattaaaaacttaggcacttgactaactttaataaaatttctcaaactatatcaatatctaaagggcatatattttttaagaaagattattctcaataacttctataaaaataagtttgatggtttggcccatctaacttcactactattagtaagaacttttaacttttaatgtgtagtaaggtttattctacctttttctcaacatgacaccaacacaatcaaaaacgaagttagtgaggtgctaacatgtgaggattaatccagtgattccggtcacaatgcattccaggaggaggtacccatgtcactggaattgngcgatatggtttattttttcttccctgatttggataaccaaatggaacaggaggaggatagtgattctgatggccattccctcgatacattcctggcttttttctgggcaagggtgcccacatngnnagagtgnanatatnnagtctgaaatctggtacacaggacttgcngctgcagtcaccgaactgggttcactttcatttnctttact

SEQ ID NO: 134 - DNA, 812 bp, Homo sapiens
ccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaaaaaaa

SEQ ID NO: 135 - DNA, 662 bp, Homo sapiens
accgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgct

SEQ ID NO: 136 - DNA, 695 bp, Homo sapiens
  misc_feature (522)..(522): n is a, c, g, or t
  misc_feature (596)..(596): n is a, c, g, or t
aaggactgactgttcaaatttcaggcaaactatgcagatggacgtggtgttggtggaggcgctcccttcacgagaccacacagggggagtgactgtggctgaccatgtgggcagaggggctggcgggctggcccctgcgagaggcggactcagggctgctggatgctccgtccttggccgctttgatctggagccacgtgtcacccagagctttggcaaaatggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggcgctcggtggcctccggtagctggcaggcccgggcgcggcacagccgctgtgcgcgatggggcagtgcgagaggttgcagttgcgggcgccagccgaggcacaggtgatcacggagggccggttctgctgtcgctcccccagngtcagtgtgggcgagaggccggctggcctgctggcgtccaggctgttcttggtcagtgcgaggggctgctccangccatagctggcgagggaagtgtacaggtggctgccgtgcatgctcatgggtgaggccacagcgcgctcgatgggctgctgctacgcttcccgggtctc

SEQ ID NO: 137 - DNA, 1816 bp, Homo sapiens
cccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctctttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttcccttttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaaaaaaaaaaaaaaaaaaaaaaaaaaaa

SEQ ID NO: 138 - DNA, 826 bp, Homo sapiens
tcatcattgctgaagtcgtgaacaaaattaaccgtgctaatgggaagagtacatctcggattttcctcttaacaaacaataatctccttcttgctgaccaaaagtctggacaaatcaagtcagaggttccactggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgacaatctcagccaaaccaaacagaagctcaatattgagatttccgatgagttcctggtacagttcagacaggacaaagtatgtgtgaagtttattcagggaaaccagaaaactgggagtgtcccaacatgtaaacgaaaaaacaacgtctccttgaagttgctgtcccttaactggcgcctcctctctactttcatggacttgttcctttgtaaatagtgcaatggggttgacattcggggtcatcgtatgtcgggaatcaccaaaggttttagagttcttggcaaactcaacaatattgactaatcaatttttattatggaatagttctaacctttcaaatacatgttctggcctggagcagagatgtgcaacacaacaggtctttttcaacgccggtgggtctccttagaacatcaaggtaggtggagtccctaaataggctataacctaaactaatgtaataggttgggcagcgttaagacgggtcaccagtatttccgcgccacttaacacgggtagttacactaagaccttgttggaaccatcc

SEQ ID NO: 139 - DNA, 7313 bp, Homo sapiens
ggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcggttgcctcttggtgctgccttggccgtatttggcacccagaatgcttcattctgtgacggtctattaataaggttgccttgctagagtttggagcagggcctcagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccacacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagactttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactctctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatagcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgttgagaaatgtaaattgtaataatgtaaatggggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtggtgtgtgtatatatacacacacacatacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagttgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaatctcgtgcc

SEQ ID NO: 140 - DNA, 1323 bp, Homo sapiens
ccattgtggtggaattcccctgcgctccctaacatgcccaaccccagctgcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcatcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattctctgatgtgaaattaatgagggtattatgtaatagatgcaccagtaggtatact

SEQ ID NO: 141 - DNA, 737 bp, Homo sapiens
ggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagcgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagct

SEQ ID NO: 142 - DNA, 3316 bp, Homo sapiens
cagaatccaggggacggttgctgagcgggcctgggacagcgggtcgcggcacctccggcctgcgcgtgtctaatccgtctgtcgggtcccgaaagacctaagccgagcctgcgccggacgggtgggctggactgagagaattctctgagctggtgacaggtgccacaggcactggggatctcaccagaaaggaaccgacggagctaggggccagcgagatggcggacgaggccttagctgggctggatgagggagcccttcggaagctgctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcactctcagcagcgggaagctgagcagcgggctgccctggcacggctggcagggcagctggagtccatgaacgatgtggaggaattgactgcactgttgcgaagcgctggtgagtatgaggagcgcaagctgatccgagctgccatccgccgtgtacgggctcaggagattgaggctgccaccttggctgggaggttgtacagcgggcgtcccaacagtggctcaagagaggacagcaaggggctagcggcacacaggctggaacagtgtgaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaagcttctgtctggccccaaagagacccctgctgcccagagccccaccagaggcccctctgacaccaagagagcagacgtggctggaccccgaccctgccaacgctccctgtcggtgctcagcccccgccaaccagcccagaaccgagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccaggggacagtatgaagaccacattcaccatcgagatcaaggacggccgtggccaggcctccacaggccgggtgctgctgcccacaggcaaccagagggcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaagatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagaacggaagctcatccgggctgcacttcgtgagctccgacaaaggaagagagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccaaaaggggttggtaaaaaccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgaaaaaaaaaaaaaaaaaaaaaa

SEQ ID NO: 143 - DNA, 3783 bp, Homo sapiens
ggggcggggccgggagggtacttagggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 144 - DNA, 803 bp, Homo sapiens
  misc_feature (4)..(5): n is a, c, g, or t
  misc_feature (11)..(11): n is a, c, g, or t
  misc_feature (19)..(20): n is a, c, g, or t
  misc_feature (39)..(39): n is a, c, g, or t
  misc_feature (245)..(246): n is a, c, g, or t
  misc_feature (310)..(310): n is a, c, g, or t
  misc_feature (312)..(312): n is a, c, g, or t
  misc_feature (340)..(340): n is a, c, g, or t
  misc_feature (403)..(403): n is a, c, g, or t
  misc_feature (435)..(435): n is a, c, g, or t
  misc_feature (442)..(442): n is a, c, g, or t
  misc_feature (448)..(448): n is a, c, g, or t
  misc_feature (466)..(466): n is a, c, g, or t
  misc_feature (469)..(481): n is a, c, g, or t
  misc_feature (485)..(488): n is a, c, g, or t
  misc_feature (490)..(492): n is a, c, g, or t
  misc_feature (496)..(496): n is a, c, g, or t
  misc_feature (502)..(523): n is a, c, g, or t
  misc_feature (527)..(527): n is a, c, g, or t
  misc_feature (529)..(529): n is a, c, g, or t
  misc_feature (534)..(556): n is a, c, g, or t
  misc_feature (558)..(561): n is a, c, g, or t
  misc_feature (563)..(587): n is a, c, g, or t
  misc_feature (589)..(595): n is a, c, g, or t
  misc_feature (597)..(604): n is a, c, g, or t
  misc_feature (606)..(645): n is a, c, g, or t
  misc_feature (647)..(657): n is a, c, g, or t
  misc_feature (659)..(668): n is a, c, g, or t
  misc_feature (670)..(692): n is a, c, g, or t
  misc_feature (694)..(706): n is a, c, g, or t
  misc_feature (708)..(721): n is a, c, g, or t
  misc_feature (723)..(730): n is a, c, g, or t
  misc_feature (732)..(740): n is a, c, g, or t
  misc_feature (743)..(752): n is a, c, g, or t
  misc_feature (754)..(774): n is a, c, g, or t
  misc_feature (776)..(802): n is a, c, g, or t
gggnntggctnctccatgnncatgctcagctggcagagnaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccnntcccatactgcagcctgcccctcgacccccagagcccaaggtgcaccgagcccaagtgcccatntnaacctctctgccctagacgagggacaanctgtcttgaagccagaaggtggagaagccagagtatgaagtgggaatgaatgctcctgttctnagaagcacacttggtttctgcatcttttgggnattcaanttgggncttacccgtttatttttnaannnnnnnnnnnnntttnnnncnnntttncttttnnnnnnnnnnnnnnnnnnnnnntttntnttttnnnnnnnnnnnnnnnnnnnnnnntnnnntnnnnnnnnnnnnnnnnnnnnnnnnntnnnnnnntnnnnnnnntnnnnnnnnnnnnnnnnnnnnnnnnnnnnnnnnnnnnnnnntnnnnnnnnnnntnnnnnnnnnntnnnnnnnnnnnnnnnnnnnnnnntnnnnnnnnnnnnntnnnnnnnnnnnnnntnnnnnnnntnnnnnnnnnttnnnnnnnnnntnnnnnnnnnnnnnnnnnnnnntnnnnnnnnnnnnnnnnnnnnnnnnnnnt

SEQ ID NO: 145 - DNA, 720 bp, Homo sapiens
gggggggggcggagggcgctcatttccgggccgcccaccacccgcgtagcaccggcagccgctgtcccggcagtctccagccgtcccgcccgcttgtggccaaactggctccagtcactcccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaagttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctagagatgagagtggaaggtgtggtctgcaagcaagtattcaagaaggtgcagtgaggcccaagcagacaaccttgtcccaaccaatcagcaggatgtgtgagccaggatccctctttgcacagcatgaggcaaaaatgtccagccacccctaggcatctgttagcagagtctgtctcttggctttgtcacttttccttttcttaaaacaaagccatgccaataaagtgacctgtgttcaaaa

SEQ ID NO: 146 - DNA, 1315 bp, Homo sapiens
gaggagaagaagccactaacattgcaggatcgtgtagcgaaacttctgtaggtacttaataattttagagtactctactttttaattaaaaaatcaacttatggttcattagaaaaaacgtggaaattacaaataatatttttaaagaaaatgaaaaaaaaattcctggaaccccaccactcagaaagtcaccagggaacggcccgctgggtttttttccagactcttccatctgtggactttgctttaagagacgtttaagacttacagcgcagtcgcccgggaaggcctgagaagctttcggaagcaaggtggtttgctcgtgattgcatttgattgcaaggagacaggagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggtaggctttaaagttgtatcaaatgtcataataaaatataaacaggagctttggagccagcacccgtgatgttagttcttctcatgcaaatgatttaaagatctcatcttgtcttgtttttctaaggcaggagagaatatatatccttaaggattcaaagaagcaattaattcatttttttccctcattgacacagaagacaaaggacaaacacagaagtctttttaaaggcttcttggaattttgtaatataatacatccaatacattatagagacaaatgtaaaatggattttcctaaataatatattcaatttttaagggagttttgttttctttcatggagatggctggaataaacaatatagccattgtttatcattaaaaaaaaaaaaaaaaa

SEQ ID NO: 147 - DNA, 3470 bp, Homo sapiens
agctttaaaaggatgtctgcgaagtggtcaaaaggatcttaacctcaattaagtggggttttttaaaaagattttttggggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtgaagatgcaatgaccggggacacagacaaatatcttgggccacaggaccttaaggaattgggtgatgattccctgcctgcagagggttacatgggctttagtctcggagcgcgttctgccagcctccgctccttcagttcggatgggtcttacaccttgaacagaagctcctatgcacgggacagcatgatgattgaagaactcctcgtgccatccaaagagcagcatctaacattcacaagggaatttgattcagattctcttagacattacagctgggctgcagacaccttagacaatgtcaatcttgttccaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatggacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgtttttaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtgatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaaaaaaaa

SEQ ID NO: 148 - DNA, 2320 bp, Homo sapiens
tcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatataaaaaaaaaaaaaaaaaaa

SEQ ID NO: 149 - DNA, 6157 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttttatggttgttttt

SEQ ID NO: 150 - DNA, 4457 bp, Homo sapiens
gtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgtttgttgtc

SEQ ID NO: 151 - DNA, 1186 bp, Homo sapiens
ggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcacttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaaaaaaaaaaa

SEQ ID NO: 152 - DNA, 3295 bp, Homo sapiens
ggtatcgataagcttgatatcgaattcggcacgaggccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcattgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcgttagtcatgggtggaagaaaaaccacaccycymrmrcccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccacccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgacttgaaagttcaggacttgactctcccacaggtggtgagctggtggctctctggtgagctagtgtctccacagmcwvtctccaaaggctcccctatgtacatttgagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttttttcaatagctactttttttagcagacaccagagccacactcaaatggctaagtaggttatgacctctctggattatttttgaatgcccaactgttgcaattcaagttttctgaactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatataaaaaaaaaaaaaaaaaaaaaaaaaaaaaaaa

SEQ ID NO: 153 - DNA, 584 bp, Homo sapiens
  misc_feature (422)..(423): n is a, c, g, or t
  misc_feature (427)..(428): n is a, c, g, or t
  misc_feature (438)..(438): n is a, c, g, or t
tttttaacgtcagacattctttaatggaatgaacatgtggcacatggatctttgggagtttgggttggattttggggatgttaaggtctcctatcaatcttagttaacatgtcacagcttctggtccctgacttagatcacctctgtgtaccctcagcctactgaggaaaaaggcaggaatcacctctgtgtcattgaagcggtgaggctccaggcatgggttccacctgaccacctggggagacggcatgaagtccaaaaatggataaatggatgttcttgtaaagttgaatccatgaatgccatcttctggaaacactataatctgtacatccttttgggctgcagtcatcacttgctgttatagatgtcaaggttctggttcatgagctccaaggcctcttggcggctgatgagagcannaagnntcagactcangatggattggatgctcatacaccgcagccacataataattagccttcgtgatggttcagccacgctctctcccccggggtgggcttcccaggcaccccacgtacagccgcagagaaaagagcaagcttccttctggcttccgacat

SEQ ID NO: 154 - DNA, 4828 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgcctttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaattttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccataaaaaaaaaaaaa

SEQ ID NO: 155 - DNA, 1128 bp, Homo sapiens
ttttatttttccttacacaatgacgtgttgctggggctaatgttctcacataacagtagaaaaccaaaatttgttgtcatctcttcaaagaatcgagaattgcgtacaaaaaaaaccttacataaattaagaatgaatacatttacaggcgtaaatgcaaaccgcttccaactcaaagcaagtaacagcccacggtgttctggccaaagacatcagctaagaaaggaaactsggtcctacggcttgggctttccaaccctgacagacccgcaagacaaaacaactggttcttgccagcctctagagaaatcccagarcactcagccctgacacgttaataccctgcacagatcagaggctgctggscacacagactcaccaagccacagacttgtcttccacaagcacgttcttaccttagccacgaagkaccaagccacacgtactaaaggttgaactcaaagatatgtacagggtattaaacaaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggtgtgtgcatttgcsaggggcaaatttctattctcaattaacccatgcagcaaatgctacgcatctgctgagtccgtttagaagcatttgcggtggacgatggaggggcgcgactcgtcgtactcctgcttgctaatccacatctgctggaaggtggacagtgaggccaggatggagccaccgatccacaccgagtacttgcgctctgggggtgcgatgatcttgatcttcatggtgctgggcgccagggcggtgatctccttctgcatcctgtcggcaatgcccggatacatggtggtgccgcccgacagcaccgtgttggcgtacaggtctttgcggatgtccacgtcacacttcatgatggagttgaaggtggtctcgtggatgcgscagattcatacccaggaaggaggctggacaggcctycggacacggaacgctcattgcaatggtgtgactggcatcgggmgctcgtactytytcmragaagagrggtgcgsggtg

SEQ ID NO: 156 - DNA, 4438 bp, Homo sapiens
actcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaa

SEQ ID NO: 157 - DNA, 684 bp, Homo sapiens
  misc_feature (365)..(365): n is a, c, g, or t
  misc_feature (469)..(469): n is a, c, g, or t
  misc_feature (537)..(537): n is a, c, g, or t
tttttttttttgctatacatctttttgatcaagaaatgcaatgctcagtctaggaacagcagcagaaatagcgagagacacgggacttttatacaaaaaaatttgttgcttacaaaacatatgcaaaaaaagcttaaaaaaaccagagaccaaaggcagcagccttgctaattttcatctacattaagaaaaaaaaaatcttgtaactaaggtttttattttccttaaaaaaaatatttcgcttaggcacaatttgctgggggctttagaagaataagccaggtttccacagcatcccccttgagagatacgctcgatttctccgcttttaatagataaggcatttttttcttctttgacaaagngaatgttttgttgcttgctttcaggttttgtttactggaaaaaaaaaaagggcaccgggcttgattccgaaatcatggacatgggttgtttcttggggaaatanttttctatcattttatttttctatctatttttttaatttcaactcttatactttgtcttcgtcgtctngcgtgggttttatctttcattattatatcttcattttctttttattttttattttcttattcttatgttatgttcttaatttttacatctctatatttaccatttttctttcgtacttctttttttcttttttatttttaccatttt

SEQ ID NO: 158 - DNA, 1638 bp, Homo sapiens
cttcactcagccaactgctcgctcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctacgggctggggggcggctatggcggtggcttcagcagcagcagcagcagctttggtagtggctttgggggaggatatggtggtggccttggtactggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataaaaaaaaaaaaaaaaaaa

SEQ ID NO: 159 - DNA, 550 bp, Homo sapiens
  misc_feature (465)..(465): n is a, c, g, or t
  misc_feature (491)..(491): n is a, c, g, or t
  misc_feature (526)..(526): n is a, c, g, or t
ggttacggcagcacttttatttttccttacacaatgacgtgttgctggggcctaatgttctcacataacagtagaaaaccaaaatttgttgtcatctcttcaaagaatcgagaattgcgtacaaaaaaaaccttacataaattaagaatgaatacatttacaggcgtaaatgcaaaccgcttccaactcaaagcaagtaacagcccacggtgttctggccaaagacatcagctaagaaaggaaactgggtcctacggcttggactttccaaccctgacagacccgcaagacaaaacaactggttcttgccagcctctagagaaatcccagaacactcagccctgacacgttaataccctgcacagatcagaggctgctggccacacagactcaccaagccacagacttgtcttccacaagcacgttcttaccttagccacgaagtgccaagccacacgtctaaanggtgaactcaagatatgtacagggantaaacaaatccaaggggacagttacttcaatccanggcaaatcgcaacaagtttacatc

SEQ ID NO: 160 - DNA, 2711 bp, Homo sapiens
ggcacgaggagagtgcggctgctgagagccgagcccagcaatcccgatcctctgagtcgtgaagaagggaggcagcgagggggttggggttggggcctgagaagcccccaggctccgctcttgccagagggacaggagccatggcccagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctacctccaaaggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgagctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaaaaaaaaaaaa

SEQ ID NO: 161 - DNA, 2765 bp, Homo sapiens
gggctgcgactgacaagcggctctgcccgggaccttctcgctttcatctagcgctgcactcaatggaggggcgggcaccgcagtgcttaatgctgtcttaactagtgtaggaaaacggctcaacccaccgctgccgaaatgaagtataagaatcttatggcaagggccttatatgacaatgtcccagagtgtgccgaggaactggcctttcgcaagggagacatcctgaccgtcatagagcagaacacagggggactggaaggatggtggctgtgctcgttacacggtcggcaaggcattgtcccaggcaaccgggtgaagcttctgattggtcccatgcaggagactgcctccagtcacgagcagcctgcctctggactgatgcagcagacctttggccaacagaagctctatcaagtgccaaacccacaggctgctccccgagacaccatctaccaagtgccaccttcctaccaaaatcagggaatttaccaagtccccactggccacggcacccaagaacaagaggtatatcaggtgccaccatcagtgcagagaagcattgggggaaccagtgggccccacgtgggtaaaaaggtgataacccccgtgaggacaggccatggctacgtatacgagtacccatccagataccaaaaggatgtctatgatatccctccttctcataccactcaaggggtatacgacatccctccctcatcagcaaaaggccctgtgttttcagttccagtgggagagataaaacctcaaggggtgtatgacatcccgcctacaaaaggggtatatgccattccgccctctgcttgccgggatgaagcagggcttagggaaaaagactatgacttcccccctcccatgagacaagctggaaggccggacctcagaccggagggggtttatgacattcctccaacctgcaccaagccagcagggaaggaccttcatgtaaaatacaactgtgacattccaggagctgcagaaccggtggctcgaaggcaccagagcctgtccccgaatcacccacccccgcaactcggacagtcagtgggctctcagaacgacgcatatgatgtcccccgaggcgttcagtttcttgagccaccagcagaaaccagtgagaaagcaaacccccaggaaagggatggtgtttatgatgtccctctgcataacccgccagatgctaaaggctctcgggacttggtggatgggatcaaccgattgtctttctccagtacaggcagcacccggagtaacatgtccacgtcttccacctcctccaaggagtcctcactgtcagcctccccagctcaggacaaaaggctcttcctggatccagacacagctattgagagacttcagcggctccagcaggcccttgagatgggtgtctccagcctaatggcactggtcactaccgactggcggtgttacggatatatggaaagacacatcaatgaaatacgcacagcagtggacaaggtggagctgttcctgaaggagtacctccactttgtcaagggagctgttgcaaatgctgcctgcctcccggaactcatcctccacaacaagatgaagcgggagctgcaacgagtcgaagactcccaccagatcctgagtcaaaccagccatgacttaaatgagtgcagctggtccctgaatatcttggccatcaacaagccccagaacaagtgtgacgatctggaccggtttgtgatggtggcaaagacggtgcccgatgacgccaagcagctcaccacaaccatcaacaccaacgcagaggccctcttcagacccggccctggcagcttgcatctgaagaatgggccggagagcatcatgaactcaacggagtacccacacggtggctcccagggacagctgctgcatcctggtgaccacaaggcccaggcccacaacaaggcactgcccccaggcctgagcaaggagcaggcccctgactgtagcagcagtgatggttctgagaggagctggatggatgactacgattacgtccacctacagggtaaggaggagtttgagaggcaacagaaagagctattggaaaaagagaatatcatgaaacagaacaagatgcagctggaacatcatcagctgagccagttccagctgttggaacaagagattacaaagcccgtggagaatgacatctcgaagtggaagccctctcagagcctacccaccacaaacagtggcgtgagtgctcaggatcggcagttgctgtgcttctactatgaccaatgtgagacccatttcatttcccttctcaacgccattgacgcactcttcagttgtgtcagctcagcccagcccccgcgaatcttcgtggcacacagcaagtttgtcatcctcagtgcacacaaactggtgttcattggagacacgctgacacggcaggtgactgcccaggacattcgcaacaaagtcatgaactccagcaaccagctctgcgagcagctcaagactatagtcatggcaaccaagatggccgccctccattaccccagcaccacggccctgcaggaaatggtgcaccaagtgacagacctttctagaaatgcccagctgttcaagcgctctttgctggagatggcaacgttctgagaagaaaaaaaagaggaaggggactgcgttaacggttactaaggaaaactggaaatactgtctggtttttgtaaatgttatctatttttgtagatattttatataaaaatgaaatattttcc

SEQ ID NO: 162 - DNA, 634 bp, Homo sapiens
  misc_feature (49)..(49): n is a, c, g, or t
  misc_feature (89)..(89): n is a, c, g, or t
  misc_feature (330)..(330): n is a, c, g, or t
  misc_feature (380)..(380): n is a, c, g, or t
  misc_feature (390)..(390): n is a, c, g, or t
  misc_feature (398)..(398): n is a, c, g, or t
  misc_feature (464)..(464): n is a, c, g, or t
  misc_feature (480)..(480): n is a, c, g, or t
  misc_feature (485)..(485): n is a, c, g, or t
  misc_feature (502)..(502): n is a, c, g, or t
  misc_feature (537)..(537): n is a, c, g, or t
  misc_feature (575)..(575): n is a, c, g, or t
  misc_feature (598)..(598): n is a, c, g, or t
ccttttctttctccttaaaactaaaccctttagtgacatttggcaatgngtggagagctgagctgatttctttcctgaaaatatcaatnttctagtttctaaccagcagaccaacactgttcacattagctgaggacactgacaggaaatcacaggccctactgatctggcacccgtagacttggtgctggggtcccgtccacagatcaccctgactcagaaccggaaacacactgggccggacgctgtgctccactccttttgcctatgcacggttctgtcctggacgggtgcacatagcaaacaattgtgccattgttcagtttttangaaaaggataattttctaccaaacaaaagaagaaaagaaaatcccccttntagtttatgnaattttgntagtttatgggagtttccatgcgctccaaaagcttggtgatgctccgaacccgggaatgggtaacntgggacaacattttcnttccnggtttttaaaatttgcnaaggggaagggacgggttaaacatttttaaacagnaaaaataccggcaagttaatgcctggtggaaaaactcnggaaagtccaagggaaaccagcnccagagcaacccttaaaaaggccccataaaccatcg

SEQ ID NO: 163 - DNA, 838 bp, Homo sapiens
  misc_feature (502)..(502): n is a, c, g, or t
  misc_feature (734)..(734): n is a, c, g, or t
tttcactgttgagaaaaatttattatcaatgtctcagagccaacgacgacacgaacctacatgaacacaactcttaatttaggacccaagggtgactgtaaacatgataggagcgctgggacattgtcactgaggcagacagcagccactagtccacaatggtttaaaaagtcagtcctgtgccccctcactggaagcttccattctgggccatctgcagatattccttgtagagcttctcctgagcctcgaagagcttcttcagcttcttggcttgccctttgctgagctctttgccctccatgtcatgtgtgggcagaccattttcatcaaacttggagtatttgtcggtttctgacaagaacatctcactggggggaatcttcatcttggccagctttgctgcttcttgttcctgtttcctccgggccgcctcctctttcttcttcctcttctcctcttcaacccgtctcttttcttctctctctgttaataaggtgtntctgtctaccagtttcaccactgtgggcagtccttcgtggtcttcaaaccgcaccccaagctcaggcaggatgttgtcccgcagggcatcgctgagctgcagaatctcagggacttgttgctgctcggcaatctttcgcactccttctcggaatcctgattacacctagagggtaggcatgactgtggcctcgaaactgaggcatgttaccagcccatacgaaccggaaatngccagagagctgtcctcttctaccggccccaaagatctcacacatatggtgaggtacaaggcgatgttcttcaacaagagctgggtgggaccttttccttcacg

SEQ ID NO: 164 - DNA, 530 bp, Homo sapiens
ttttgggggtggcagtgcactttattaacaaacaaaacagtaccatacaggcaaaatcttacttcagtggcaaagcacacacataggtatactccaacgtgtagcactggggcaaacttcagacatggaacattaggcaccaagttcacaatcacactaaacatagttcacaatccttcaatccatactcttcagtggaggatgaggccttatttaacagttaactgggacagacagatgaagttttaaaatctaattcttggcctaactgtggagtggggctgactcagccttcagaactgtgaagtggatgccttaacagggccaagatctatcagcctcttaaactgactttcatttctctggttcagagaaaaagcttatggtatcttcacgttggatgaacttgcatatcgtgagagtcctcagctccaatttcgtgtctaggcacatctggactggcattcattttgatacccaatccatagattaatagggttaatctaattagaataaattaaatcgttttc

SEQ ID NO: 165 - DNA, 1761 bp, Homo sapiens
ttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttccccctttttgtcccccaacttgagatgtatgaaggcttttggtctccctgggagtgggtggaggcagccagggcttacctgtacactgacttgagaccagttgaataaaagtgcacacctta

SEQ ID NO: 166 - DNA, 2740 bp, Homo sapiens
gcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgtggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgctcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcagacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttacgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagtcctagaggatccctac

SEQ ID NO: 167 - DNA, 3572 bp, Homo sapiens
acctgcacttctgggggcgtcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaaatcaatcacagcttgtattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaggcatttggcatttatttgtgatgacaactggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaa

SEQ ID NO: 168 - DNA, 1165 bp, Homo sapiens
gggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattgggtttgttacctcgaggtgagaaacccaatcctttgaggcaaaagaacgccaaggtgaaccaactcctcaaggtttcgctgccgaagcttgccaacgtgcagctcctggataccgacgggggttttgtgcactcggacggtgccatctcctgccacgacatgtttgattttctgcatctgacaggagggggctatgcaaagatctgcaaacccctgcatgaactgatcatgcagttgttggaggaaacacctgaggagaaacaaaccaccattgcctgactggctcttatcagtgttaatagcatctcagcttcctcagatcagttctatcactggcactacagaatccttctctttcttaaggcactttgcattgtagaatgttcctggatgttcatatctagtgtttgaaggggaggagggatttaaactggtcctgtacatagaaggtttgtttgacagaggagaaaaattagccaaggaagattgttgtttaaattcatttgaaaccagaaggggactttttagttgtatgtgtaacacattcattgaattattatcactgttttcttgggacaacatcaagcctaaatactgaacaatatgaagattaaaaaaaaaaaaaaaaaaaaaaaaa

SEQ ID NO: 169 - DNA, 1520 bp, Homo sapiens
aaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatgcttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggtaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcc

SEQ ID NO: 170 - DNA, 1047 bp, Homo sapiens
  misc_feature (13)..(13): n is a, c, g, or t
  misc_feature (19)..(19): n is a, c, g, or t
  misc_feature (26)..(26): n is a, c, g, or t
atcaaaaaatggnggaganggatggngctgggagagatcaagaattggggagcagatgggaggcgctacctcactcaggagacacgagtacttatccaagtacaaggtgaaaaaagtgagggcaggaagaaaaatctccctgctagcaacagcsactcagggagaaactctgggcccatagctagctggaggcagggtgacattgctcccaccaatgggccatcttcttagctacacctttgtagctgtggtgccaggcagaggaaccacctggaaactgagctaaggcaggttccttcttccaacagaagacacagctgggcagggactgtgcagactcaacagggccaggccagcyagtggccagtcagtgttcatgtctctcaccagttcctggagggtccccagccaaggacagawctggtcagttcctgccagcagcttgagctggaatgccctgggagggtcagtagagggtggtcacttgaggagcttcacagagaggcggatgtcaacatcgcagaggaagatgtccatgaggtcatggcctgcctcctgtgctatctgggagatcacgtggcccttcggaccaatcaggagtttcacataagattctttgggcaccagaagcttctgttggataaccagctccccacctggtccttcctcccacactgctgtcttctgctgtacattgtaaggcacctcctggggcaggtgttctaggagcttctctcggataatgttggcacagatctcttctggtgtctggctagtgaggactgcactgtggtactcccagggccctggctgggcctgtgtcagaaggtattgctttagtgttttcacgtcctcctggcttagggcctgacaacatgaagatctccttgaagtggggccagccaatcctctgaggatttcccacagattgtgtgtttgggtcttaactgctgggctgggggaatgggtgcagggtgtgagttgaaggctgcctcatcttgagcttttkccattgacamacttcagtkagggckgcgtrasyccagg

SEQ ID NO: 171 - DNA, 896 bp, Homo sapiens
agagaggagtctggtagcgtaggctaggtcgagtgctggtgtggcagcgcgatgccaaggcaaggcaaaccggaggcagaagtttggttacagtgtcaaccgaaagcgtctgaaccggaatgctcgacggaaggcagcgccgcgatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataagagtggcaagacttcctcgattctttgcagaagaggaagatggaggtggagtgactggtttactcacagctgccccaggctgaggcgtcccccggaccagtgaagctggagccaggtgtaggcaggaggtgctgtgtggctccgaggagctggccaggtcccatggaattcgaggttccacacacgtgcacactccccgctctggggaaggaactgttctcagaggctccattttatcatctgggggtcaacggaaaagcagaactgctgtttcagggtgggtgatgtaatttgtgtgtcataataaagcaatttttttaaaaacaaaaaaacccgggccttatttccggtcggaaaaagaggttttaaatggccatgcctaagcttttcttgccagtttttccaagggaactgcgggccaatgggcgaaatcgacgtagcccacaaaaaaaaaaaaaa

SEQ ID NO: 172 - DNA, 1535 bp, Homo sapiens
aaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacaggaaaaaaaaaaaaaaaaaaaaaaaaaaaaa

SEQ ID NO: 173 - DNA, 1146 bp, Homo sapiens
ctgtgcgcggagggcgtggcctgtgcggggcgggacttattgcccgcgcggtgagggagcgtggtctcgcgcaagccggcgtgcggtcccgcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaactaaaaaaaaaaaaaaaaaaaa

SEQ ID NO: 174 - DNA, 513 bp, Homo sapiens
atgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattga

SEQ ID NO: 175 - DNA, 2459 bp, Homo sapiens
tcgacccacgcgtccggacaaggaggaggaggaggaggaggtctggctagctgtccctaacgtcatttcctggtctcaactctttaagaccctgacatactctgagattggagtgaagatttctgtgacatgctgggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtggttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaaaaaaaaaaaaaaa

SEQ ID NO: 176 - DNA, 790 bp, Homo sapiens
tttgactatttaacaaaaatatttaatgctgccaaaaagtataaaaatacagtaggaatggcagtacaatacaaagtaatctctcctaatttatttcttgtacatctttctacatttcatacactcattaaaaacacttaacacatccaattaaaggttctgcaaagtcttctgctggtgggtgctcttcatcccctggatgtaaagtttactttgtaaacaaacaactgtgaggcaatctagagggttagcgagcctcactttagtttccggagtgggcttcaggtcttgctttgcacatcaatggttcaaaatttatagctgcagaatattctcaagtcatgaatattaggtgtctgtcaatcttggcctttttctttttcgttcattctcatttagcctctgtttcatctgctgcaccttctgagctgtggtggcctttctgtcctctcgaatacgtttccgtagagcactctcactgttctcctccattgtatcttgcattttagaggaaagtcctgtacatcggtcacctgtcagttgttcttcttctagacctatgctgttcccattgtatgtttcagtcattattttgtttggtgaatgatcaaaggcacgagataagtcttccttagaaagttcttttcatcgtttctgtatactaggatactcccttatacattgtgcttcctctattatacccatgtatgagaatatcagttgatctggggtctgaatagaacccattcggtatttgtcatgtgagatgacactgggtttatgtaagtat

SEQ ID NO: 177 - DNA, 1794 bp, Homo sapiens
  misc_feature (1782)..(1782): n is a, c, g, or t
  misc_feature (1788)..(1788): n is a, c, g, or t
caagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggtgggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatcccagcagatggatgttgctgctgctgtttgggctgttgtttcttatgttgttgcagacatggaagaaatgctgcctaggtcctagaaacagtaagaaagaaacgttttcatgcttctggccagggatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatttttggaagatctctgaaaaaaaaaaaaaaaaaaaaaanaaattncctgcg

SEQ ID NO: 178 - DNA, 1710 bp, Homo sapiens
agtcccgccctccttgctgtcacaggtgcagcctgtcctctccttcccctgaccagcccagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcagagagcaatgatgaggaccagcaacccagagcaaccggaaaacatcgacggagcctgggggctggatacccccacgggaacggctcacccggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcgttctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaat

SEQ ID NO: 179 - DNA, 926 bp, Homo sapiens
gcagcgggcgaaaggagccggggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcggattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaaaaaaaaaaa

SEQ ID NO: 180 - DNA, 2095 bp, Homo sapiens
acgtttaaagctgagcgacccagtgccactggagacggtcagcttctccactcaggctcctccagcccgagccagaagaccccctcccccataattctgggggccgatggaagggagccgagtcagatcgcgaggtacccatagccgacagaccggagcgacagggagttgccataagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaatcctgagagcaaggaagaacatgcgatatacacagcagacctagccatgggcacaagagcaccctccaatgggaagtataagggtccataccagaccctggggggaagggctctgaaggagaacccagttgacttgcctgccacagagcaaaaggagtgagtggaacagagttgcttcttaataggagcacattctttgcctgccttcccttcatcctatcctctttgcttgctctcacctcaggaattgcttggattgatacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcatacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctatacaggaatctctggaaaactatcagaagacaaagtttgacaccttgatacccactttttgtgaatacctacccccttctggccacggtgccatacctgtttcttcctgtgactgtagaaacagttctagacctttgtgatagaactaaaatgctctctgtactctagtctcctgcctcctcagttctgcaagtagtttagtaggaatgaagtggaagtccaggcttggattgcctaactacactgctaaaaatatttgtaatccttaataattaaactttggatttgtt

SEQ ID NO: 181 - DNA, 3135 bp, Homo sapiens
ggcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttcttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttaaaaaaaaaaaaaaaaaaaaaaaaaaaaaaaaaaaaaa

SEQ ID NO: 182 - DNA, 10442 bp, Homo sapiens
  misc_feature (9881)..(9881): n is a, c, g, or t
  misc_feature (9884)..(9884): n is a, c, g, or t
  misc_feature (9999)..(9999): n is a, c, g, or t
  misc_feature (10046)..(10046): n is a, c, g, or t
ggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacgggcgtccctgctgtgagctctggccgctgccttccagggctcccgagccacacgctgggcgtgctggctgagggaacatggcttgttggcctcagctgaggttgctgctgtggaagaacctcactttcagaagaagacaaacatgtcagctgttactggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctatatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaaaggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatactctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcgatctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatgtcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatattgggcagccttttttttttttttttaattgcaacaatgcaaaagccaagaaagtataagggtcacaagtttaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcaatttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacgacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgctgtgttttcttcttgtggntgnatatatcaggtaaaatattttccaaagagccatgtgtcatgtaatactgaaccctttgatattgagacattaatttggacccttggtattatctactagaataatgtaatactgnagaaatattgctctaattctttcaaaatggtgcatcccccttaaaangttctatttccataaggatttagcttgcttatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttaaaaaaaaaaaaaaaaaaaaaaaaaaaaaaaaaaaaaaaaaaaaaaaaaaaaaaaaaaaaaaaaaaaaaaaaaaaa

SEQ ID NO: 183 - DNA, 2752 bp, Homo sapiens
gcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaaaaaaaa

SEQ ID NO: 184 - DNA, 5177 bp, Homo sapiens
gtgttgaaagacagagaagcgaagacagagacgtggaaagacagggagagagacacggagagagacgcagaaggacagagacgtggagagagacgcagagagacagagacgtggagagacacagagagacttggagagagacaaagcaagacaggacgggagaacaaggacaagctcaggtgcccctggagccccagccctgccttcatgcccagcaggtgccctacctggcccatcctcccaaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgaaaaaaaaaa

SEQ ID NO: 185 - DNA, 2478 bp, Homo sapiens
gacgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaatgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaa

SEQ ID NO: 186 - DNA, 838 bp, Homo sapiens
cttcccactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccata

SEQ ID NO: 187 - DNA, 534 bp, Homo sapiens
cgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccaccca

SEQ ID NO: 188 - DNA, 1473 bp, Homo sapiens
ggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaaaaaaaaaaaaaaaaaaa

SEQ ID NO: 189 - DNA, 5579 bp, Homo sapiens
ggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcactgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagatgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcacagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccccctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaagggaggagtgggctttgaacttagacatctacctcagagctcaaataggttgtttaaaatcacattcaattttcagatgaaggggaactttatagttttttttttttttttttttttttttggggcggagtctcactgtgttgcccaggctggagtgcaaatggcttgatcttggttcactgcaacctctgcctcccaggttcaagcaattctcttgcctcggcctcccgagtagctgggactggaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacgcctctggtcccagctgctcgggaggccgggacagaaggatcaccttgaggccaggagtttaaggccagcctgggcaacatagcaaaacctagtccctaaaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatgctgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtat

SEQ ID NO: 190 - DNA, 1182 bp, Homo sapiens
aggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacatatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaaaaaaaaaaaaaaaa

SEQ ID NO: 191 - DNA, 5015 bp, Homo sapiens
gagtggagttctggaggaatgtttaccagacacagagcccagagggacagcgcccagagcccagatagagagacacggcctcactggctcagcaccagggtccccttccccctcctcagctccctccctggcccctttaagaaagagctgatcctctcctctcttgagttaacccctgattgtccaggtggcccctggctctggcctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctacttttttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacgaaaaaaav

SEQ ID NO: 192 - DNA, 1043 bp, Homo sapiens
tgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtgaaaatgcaattacaagagccaa

SEQ ID NO: 193 - DNA, 557 bp, Homo sapiens
  misc_feature (437)..(437): n is a, c, g, or t
  misc_feature (510)..(510): n is a, c, g, or t
  misc_feature (522)..(522): n is a, c, g, or t
  misc_feature (534)..(534): n is a, c, g, or t
ttttttttctgtctaggattttattagactgctttttttctcaatatacctgtattggaagattgagacaaaaaggcacaaactcacattaaataaacaaggtaatctaatcaattctacaaagtgtagtttgtaaaacaagtagcactaggaaccaaccaaagtaagtcagggagtcccagcagggctgttaaaagaacttgggaagctatacacatgcccacgatactgaccctgtcccggacctctctgcatgagaaggccagagcccagcacccctcctacagaggcactgctgcttctgttggggctgtgaccctgggaattctgatggaagcagctggtctgaaggggcatggcacacactcaggtactacccctgggagctggaacctttattcataagtccctctgagtgctagtcagtttgggaggtnggttgaggagggaaggggggtactttaaaagaagccaacattgtttgcccagcagcaacaccttccctggggntggaacagaccngggacatcctcntttattgtttatgtgggctgcat

SEQ ID NO: 194 - DNA, 2884 bp, Homo sapiens
tcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgct

SEQ ID NO: 195 - DNA, 1036 bp, Homo sapiens
aggagactaagtaattatggagagagaaaaaaaggttttattgaagggtaggaacttttgaaatttggacaagtcaataaagaagtaatttgaaaaaaatattacatttgcatttttttcttgttgagcatcttaaatataatatttttggagtactaactattctttattgctgtaactgttaaaagtttaattmctgagatttttggagtcggtaaaagttcttaaagtgagcagaggaaagaaatgtmtttmycagataggagghtgaactgtgaatmaacagtgtcaatmagttactttctgtcatttttccatacagcagttttcatctgggatatgtttayamtgtagtttattcmttgamtgcmcccaaaatatamtamtctaagaagctcttggaagaactgaaatgttcagttgaaagatggtatataagtaaaaattattattgtgaaatatttgtmattgttaagtagctttmctcttttaaagtatgaacttgtatgtgagtgttttamatctggtttgatttaaataamaattmaagtatmtmctttaaaatgatgttmtgaagaamattaatatttatgaagcacagatataaatacamtttmtgaaaggmagaatattgaatattaattgaaaataatttgttttgatmattttttagaatataaagattamaamatagmatttggtamaaataamatttttaatagttmataamtttttatamatataattaamtaaaaatttagaaaaagtttataamaaagtgcatgaaggaaaamttawwamtgtwahatttaatttaaaagmtatattaaaatgmagataggatatgaatataagmtatttgtgcttattttaagmtatggmtaaaaaataagcwwgttaattgggyttttgmttgaaatggagytgtataawagtattgaaaatgcattmmmttagmagttgtgatmttmataatagcaamatttwaaagcataatattmaatgmgtgttataawtaattggcaataaatggcgg

SEQ ID NO: 196 - DNA, 529 bp, Homo sapiens
acataaaataaacccttagcacacccgtccactgggaagcagagcctaagctgaccccggccactgggctggtgggaccacatccaaggcatgaagtactggcagcacggggagcttgcaagagacagggacatgaagttgtggcgtctctggcacgcaagtgtcctgggacagagcaatggaaacctacaggcatgagaatgagggttgcttgatggcaagatttcagctgctctgctcacactacctctccagcaactggcacaacgcaggcacctggcacatcccagcatgccatacatatctgttgaagccacaactcaacagtttaacctggactcacctgagagaggcctcctgcatgtgaagccctgccaatgacacagcctggagagcacctaggatgggtgttctctaatgggggaggaaggtgggcttaggaggctgctggctgaacatgcgatttgcagttattaggcaaggtggggggcctgaactcaattatagactctgtcagggctgtttgact

SEQ ID NO: 197 - DNA, 318 bp, Homo sapiens
  misc_feature (255)..(255): n is a, c, g, or t
tataaagaagatcatgtccatgttaacattattataaccctacattttgtgcataaagtgtaagtgtataagcatatcaatattaaaaagcaagcaagcagaatttggaattcatccaatccaaatgcggcatcttcaaacctccatgatgctgcttacatgtctcgatcccacttaactatcttgggctgtgacaaagtcacatggttcacacggcaggcatactcatctttttcagtgggggtgaattcagtngtagtacaagagatagaaagaccagtccttgctgaaagacaagtctgaatgctccactttttt

SEQ ID NO: 198 - DNA, 1082 bp, Homo sapiens
actcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcatccgcgggtatgaacggtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctg

SEQ ID NO: 199 - DNA, 114596 bp, Homo sapiens
gatcctaatgacccagtaattttcctccaagtccagtattctcaggattaagtcctaatcatccatctacccactcacccactcattcatccatctgtccatccatctatccatccatccattcatccactcacccatccattcatttacttattcatctattctcccattcacccatccatccacccacccacccacacatccacttatttacccacccatttcatccattcttccatccacccatctatccatctatctatccactcacctgtctatcaatccatccatccatttatccagccatccattcacccacccacccattcatctgtcctcaatccactcacccatccactcatttactcactcattcatctattctcccatccaccctttcatccactcacccaccatccatccatccatccatctacccatgcatccatccatccacccatccatccatccatccacccatctactcattgacccactcatttcacctattcttccatccacctatgtattcatccacccactcacccatctactcattcactcacccattcatctattctcccatctacccccattcatccaccagtccatccatccatccatgtaacatttactgaaggctcactacctgcctgcaaggttcaggtgagggacagagcaggactgtacaggtgtctctcagcctctaccctccctcattcctgcttccatcttcttctgatctgggataattcctctcctgggagatccaaggatgatggggagcaaaaggcggtggggtgaggggttggggcttcggcactgcctctctactgaggccccagtcccttctctgtatggacaaaatggaaacttgtggtttttcttcctgcattgaaccagcaggctgagctggggctgaactcctgggacattaaaagggggtgagaggtgaagatgcatccaggtggggggtgtgtgtgtgtgtgtgtgtgtgtgtgtgtgtgtgtgtgagagagagagagagagagagagagagagagagagaggaggtggagggcgaaaggcctgtgcatctctgtctctgtcaggcacacagagaatggcagtggtgagcctgcaatgtattgggaagacattattgtttgctcagaaatggccaagaaccccagctcctccctgccaggagacacaggattctgcgcctccaggcacaaccgtcttccctcccttccactttcctccctcctcctcaaacccttgcccaggtgccccccggctggctgggttcaccagaggatagatgaccacatactaatcccagcctcctgtggaggttagtcccaccctccaccgaggtggaaaattcctgcaggtagagtcagcagtggttcaagtcccaccgttgtccatgagatcggactacacagcacacacggccgcttttttttacctaccacgtgtcccacgtctcctacagtcctttaatccctgaccagtccttcagaggatggacacgctctgatctttgtagcctctctttctctcctcagggatcacacctcactgtagaccacagcccaatgtcccaggtgactcacttactagaatttgtaattcacttcatcctgccaccacgcccctgtgagctagacacccaaattgactccattttacagatttggagactgaggtgcagagagattaagtccctgtctgaggtcgcatggtggatgagcagcagacaccctggcgggcagcctggctcctgagccacgcgtcaccaccgtcttagtggaaaatcggccacaaggagggattccccttccagtctcctggcccttgccaaaggatccatactagacatgagaggaggaagggagtccacaccgagtctggcctcaaaccctcattccttaggaaactgcgctaatgtcgccccctccctccctgtgaccaccccaggttgtatctgcaccttcccagctagcccaggtgtcattacatatttatctgttgatcactcggctccagggactgccatatcggcccaggaagtcacgatcttgtctgtctggttaggggctgtggtctggcactgggcacatagtcagtattcaatgaattttggctaaagcccttttggatcgatcatctattgccagtgtggctcagatgcagcccccgccactgactgtgtgactctggcaggtcacaacccctctctgagcctcccttccatcatctgtaaaacagacttatctctgagtcctacacatgttaaacactcaaaggatttctgttgcatgaattagtgaaatccgagctggaagggcctctagagcccagggttgcaaactcatagactccaaaagccaggcaggagccagaaaccaccgagggagctgggtggggacggaggcagctgctactcagctctagtcacaagcactgccatatctggtttctcaagaaaaaccagaaatctagagatttacaagaagtttcccaatttctaagtattggcaactaatttaaaacatttaaacacatctgtggacgggatgtggctgcaggccgtttctttgcaactcatgattcatctaactgctcgtggcacagatgagatcaaagcccagagaaggtgagccaccagccccaggtcacagagcacaggaagtgaagaggaaacagtgacctttctccttcggctgcagccctgttgcccaagctcagggcaacccctgagccctgatcccaagggaggcagtgccgccttctcctctaggcctggcagttccagggtgacaggaaggtcacgatatctctgtttgggtgcactgcagcctccgcttcctgccaggaccaggctgtatcaggcactgggatgaagaaaacattccaagcaatgggctggcctagaaggtaagagctggtggcagagagggggtaagcacaccccttccttacttcagggacgtgcaaaccccttcagcaggcctgggcagagctgggaacagggcggatcaagccctgcttctggagaaacatgctctgccattggaggctgggagctctgtccccgcatggctcgtaggaccttggaatgcatttgtccagcagcttctaatacaccaggccctcatctgacccgcacccccacaacctccatgggctctcctccctctgtcccctcttgatctctctacgcaggcacaatggtgcctgctcagccctgaacacagcagccctgctcccacctcagggcctttgcacacgctattccctctgcctggttcacttcacccattatgcagatggcttactgtagacctctacttgaatgtcgccttctctgtgagaccctccctacctgttcactctgtttaaaaatgcaaacatcccccacagtccttagcctccatctggcttcctttgaccctgctgtgcttaggatggtgggacacatatgttacacgtgtttatttgtgtttccctttcctgttgctgctgtaacaaatcgccgtgaacttgggagctggaaataacatgaatgtgtgagcttacagttctggagggctgaagcccacagtgggtctcagcaggctaaaatcaaggtgtgggcaggaccacgttccttctagaggctcacagggagaatccgttcctccagcttctcaaggccacctgtattcctgggctcacggctccaacctccatcttcaaagccagcaacggcgaggccatctttcccatgctgcatccctccgcctgcaacacctctgcttccctcctgcactaagccccttgtgatgacactgggtcacgatgtcatcatctgggtaatccagggtcgtctcccccagctcaaggagactgctcagcagcctccattccccttggccgtgtaaccttgtacattcacgggttccagggatgaggacgtcttggggaagggcgcatgagtctgctgaccacacacaccaaacacaccaggcgttggctccaggaaggcacgtggtttgctgctttatgtatgtccaatgcctggtgcatagcaggtgctcagtagacccttggagactgcgtgggtgctggagtagaatgttgtggccgccaaagggaggcaggaaaggtgactcagctaccccagtggtcctccccgtcttactgatgaggagactcggggagagctgagatgctgagggctgaagagctgtgacttagcccctacccttccacacccatcctgtgcccacaaagaggggtgggccctgggctgtgtcggggagccccaaagagaaggcctgaagtccggcagctttaaaggggacagtcctggccatgagccctctctctgagcgcccctcacaacccctacaagctcccctcccaaggctaggccagcagtgcctgcagggggctgcccaggcgtggtcctgccatgtgggaactgcctgtgtggcccagcaggacccagatgagtcacaggaaagctggggtgccctccctccagccccacgtgtctccctggcttcaaaggaaaccgactgagggtccaagtttcctcatgactgaaaaatgttccaccccaaaaatgttccacatgagcaacagctcacccagaaagaaagagaaatgaagtaagtggcttttcagcatggggagagacacttggccatgcacagctacaggcagagatctgggaaacagaacgccggggaaagcaagtgaggaacaggagaactctgcaaatcagaacactcatcataaaataattctgcttgtttcacaaggacacatatacatccagggacatatatcatgggcctcggtatggaggctcaaggagaaaacaaaacaaaataatttattttgttttaaattattattattatttgagacggagtctcgctcttgttgcccaggctggagtgcaatggcctgatctcagctcactgcaacctcaacctcccgggttcaagcgattctcctgcctcagcctccccagtagctgggattacaggctcgcgccaccacgcctggctgatttttgtatttttagtagagatggagtttcaccatgttggccaggctggtcttgaactcccgacctcaggcgatccacccgcctcaacctcccaaagtgctgggattacaggcgtgagccactgcgcctggcctaaattattattatatgtttattttgttttaaattatttttatattttacaatggagcttcctgacatgtgacaatgatgctacggttttttgttgctgtttttttgtttgtttttgagatagagtctcactctgtcacccaggctggagtgcagtggcacaatctcggctcactgcagcctctacctcccacgttcaagagattctcctgcctcagactcccgagtagctgggagaacaggtgcccaccaccacgcctggctaattttttgtatttttagtagagacagggttttgccatgttggccaggctggtctcaaactcccgacctcaggtgatccgccacctcggcctcccaaagtgctgggattacaggcgtgagtcactgcgcctggccaatgacactatgcttcactgaacaagcaaaaggtactctgcttcactcttcatttaaaaatagaaactgaaaccatactgagacacctgcttccatctattagagtgacaaaaacatcagaaagttcacaatacatggtgctgatgaagttgtggggaaacaggcaccctcacacattgttggtgggagaataaattggtacaacctctacaaagtgcagtttggtcatatggatcaaaatgtaaaatgcacaaatctgttataaaatctgacttccagagatttctcccacagatacattcacacacacacacacacacacacacacacacacacacacacaccacactatgtacaaagacagtcaccacagtattgtttgtagttgttgttgttttgagacagggccttgctctgtcaggctggagtgcagtggcgcaatcacagctcacagcagccttaacctcctgggctcagtgaccctcccaccttagcctcctgagtagctggaaccacaggcacgcaccaccacaaccagcttgttatttcatttgtaaacatgaagtctctctatgttgctgtggctggtctcaagctcctgggctcaagcaatcctccagcctcagcctcccaaagtgctgggattataggcgtgagcttctgtgcctggtccacagtattgctttataacagaaaaggctggaaacaacctaaagggccatcagtaagaaaataactattaatgaatatggtccggccatgcagtggaatactatgcagctgtgaaaaaggacaacacaggtatgtgtgatgaattagaaagaatgataggtatgttaggttaaaaaaagcaagctgcaagacactgggtgtaacatgcatctatatatgtaaataaagagtgcatacaatcatgtgtgttttcgtacgtacagactttcagtggcagagcccgtgggaaactggaagcagcattgcttagggaaagtgaaacctgggggttaagggtggggagagacactcgttttcattggatacttttttctgtcattgaattttttcccatttaaatgtcttacctatgttttaaacataatttttaaaatataaaagcaatgctcacttgtcacaaaatctaagcaatgaaatgcaaatgatatgaaaccagttgtccctaaccactcccctgaaatcactactattaacatctttccagagttaacaaaaggtcttaagtttagatatgcttctttttttttttttttttttttttttgagacagagtctcactctgtcacccaggctggagtgcagtgaaacaatcttggctcactgcaacctctgcctcctgggttcaagcaattctctgcctcagcctcccgagtagctgggattacaggcgcccaccacaatgcccagctaatttttgtatttttagtagagacagggtttcaccatcttggccaggcaggtcttgaactcctgacctcgtgatccacccgccttggcctcccaaagtgctgggattacaggtgtaagccaccgcacccggcctagatatgcttctatattattcgaacttgtgcaacaggctgtgtgatttgaaattaaacacaagggccaggcacagtggctcatgcttggaatcccagcactttgggaggccaaggcaggtggatcgcttgagtctaggagttcaagaccagcccgggtgacatggcgaaaccccatctctaaaaataataaataaataaacaaatagatagatagataaataaaggaaattgaacacaaaacctcccttttgagtcaacgattatcaaggaggctgttatagttgcagaggtggcctggacagagtggtggccatagagacagagaagtggccagttgtaggagcaaatgtcacaggttcaactgacagggtcagacgcacaggcagggagaaacaggagggaggacatgccatgagctcccttgtctaggcccacactgaggtgacacggcccaagtgccccagcccgacagggtagactgcgatcagggtcaggaattcagtgaggcaggtcctggagcactgggagggggtacgagggtctcagatatctggggctgggactcttgaggtcatagcaagataagtggatgacatactcagtttcaagagttaaaccccagatttacatggctgcctggagtctggattcactggtgtgaaatttggagggagatgacgataataagaatactaatactaacagtaacaataactatcataagaacagaggccaacactctgtagcacttactacaggccaagtgctatatacgtgttaactcataatcccacaatcaccctctagatataggtgggtatagagaagcatgcccccatttcacagatgagaaaactgaggcccagagaggtgaagtaatttgcccacggtcacacagcttgtatgggatagagaagggcagggcgtatcactgaacaaaatggaggtcccttcaccccagagttgcaaacccagcctccctcactcccactacccctctgggcctcactgcatggatggacagtggcaacaacccctcctgggcctccctgactctaccctcgtcccccattccccacaacagtcccttctctatccagcggccagagcgatcttcctaaagttctagtctcatcttcccttggtctgctctcaggcagggccaggcattaggtgaggccagcaggtgccggcacaatgtcaggagacccccctcccaggtgagcccctgctctggcctgattcacagcgaggcctccttaggttttgaacactcagtgtccctcttgcacagatgggaacagacagtctctggaatccccccaaagccgcatttgaagtttctttccaggcagacaggccctttccaggcggatggctgcttcaatccagatgaggatggaggcctggggatctggcagctctgggctgatggcaccacgtccaggggagaggtttctgttttcctgcagtggttctctggcctatgcttgctggatgggggtgttggtaaatcctccagcttcctggggcctggggaggagcaaccctgaggtggactctgcacccactcccagaggccccagcaggacggagccccagctgcccaactgataacctgctcatctagacacccagcagtaccagctgccccctcccctctgctctcagagcttcctgcgatcagctccccgctaagttccctgcccttggactctctaagtgtctgcttctggaagaggcccaagccaagacctgggagacaggtcagtggctcagggctctgtggctcatgatatctgcagtattctctctgtggcctgggtcttcctgtcttctgggtgatccctcggcctttgggaggccgaggtggttggatcacctgaagtcaggagtttgagaccagccagcctgtccaacatggtgaaaccccgtctctactaaaaatacaaaattagccaggcatcatggggcacacctgtaatcccagctactcgggaggctgaggcaggagaatcgcttgaaccccggagggggaggttgcaatgagccaagatcacgccattacactccagcccgggcaacaagagtgaaactctgtctcaaaaaaaggaaaagaagagaaaagaaaagagagaagaaaagaaaagaaggcaaggaagttccatagcccatacagtgggtatcttaggcagggctctatcagatgaaaaatatagcagaaccctgactcaaattggctgatgtcatgagaatttacgtcaactgtctctggtaaaagcaggagtagagataggcttcaggcatggttggatccagatgctaaatcaatgtctacaaagatgcactacctctggctctcatctcttttactccacacagactctccaggtcatgatgtgaccaaggttgccccttgccactcccagctttattctcaccagctcagcaaccccagggaaaagggagcaccaatttccaattgtttcagaacaaggtcagtggcaatgttactcaaactcgaacgtgcccatgttcacactggggccctggggactatgataaaatgcagattctggctcataggtttggggtggggactcagatgctgcattcactgcattttttttaagatagagtcttgctctgttgcccaggctggagtacagtggcatgatcacagctcactgcaacctccactcctggcctcaagtaatcctcctgcctcagcctcccaagtaactgggacttcaggtgcatgccattatacccagttaatttttgtattttttgtagagacctggtcttactgtgtcacccaggctcgtcttgaactcctgaacccaagtgatccacccacctcggcctcccaaagtgctaagattacaggtgcgagccaccccgaccagcccagatgctgcatttctaacaagctcccaggtgctccttgtgctgctgatctggaaccatacgttgagtaggaaggtctttgcatgatgccattcctctcagctaaaagcacattgtaggccaggcatggtggttcacgcctataatcccagcactttgggaggccgaggcaggtggatcacctgaggtcaggagatcgagaccagcctggccaacatggcgaaactctgtctctactaaaaatacaaaaattagctgggcgtggtggcgggcgcctgtaattctagctactctggaggctgaggcagtagaatcacttgaacccgggaggcggaggttgcagtgggctgagattgcagcattgcactccagcctgggtgatgagagcaaacctccatctcaaaaaaaaaaaaaaaagcacattgtatacatatgcagaatattcatctaaagaaaaatcgtaatcaaaattaaaaagtaaaagcacattgtgcacacacaggaaactattgctgcatcccaagagtcccgcatgcagtagctcatcaactggtcacaaggacgttagaggtgggtgctctcattacctcatttctccacaaggcccagacacattcccaagcctgcacagctgggaagcagcgaagctgctttgaccccaagtaatgaattctccagatggaataaacaagggccctgctgatggcccttaatgctctttgcaatcctcctctattacaaaaccaccgtgctgagcaaccccacaggtgcgtgtgtttgtaagcatgcactagtaggtttggggaaagagattcctacaggcgaaattgctgtatcaaaagatgatgtatggttctattattgctaggggctgccaaaagggaaagagactgcccatttccccacatccatgccagaactgcatgttcttgtttttgccactctggggagaggcgcccttcctcatggccctaggaaggtagtgaagttatgtcccagccccaggtaggcagcctccttcctgcaaggggtcatccagggagcaccctgtgccagcccacctctgggcatcctgttgtcatggaaatatttcaaggcctgctttcatcctgaatagcaacttcagtggaaagagaaggcctctgttatgggctaaattgtggtccctcaaaattcatatgttgaagtcccaacccccaagacctgaaaatatgactgcatttagagatggggtctttaaagaggtggttacgtttaaatggttgttagggtgggccctaatccagtctgcccggtgtccttataagaagaacagacctcaggagcgcacatgcacagagggatgaccgtgtgcagaggcagcaagagggtcgccatctgcaggccaaagagagaggccttgacggaaatcaaccctgacagccggcatctcgagcttggacttccagcctccagcactgtgagataataactgtgttgcttaagccacccggtctgtggtcttttgctatggcagttctagcgaacaaatatagtctctttccctgcacacctagaagagttcctgggaagatgcccatatgcctggcttggttcacttcccgtctgttaccaattgctgtggccaccagatgctgaactctaatcggtcaggccttggccaagtgctcatccctggagctagggatgggctcagcctgccaacctgggttcacttttccttgtttgattaaaaattttaatttaaagcaagtgacggctggatgcaatggctcacttctataattccaaccttttgggaggccaaggtggaaggatcacttcagccccagagttcgagaccagcctgggcaacacagcgaaacctcaactctacaaaaaatatttaaaacttagccaggtgtggtggcacccacctgtggtcccagccacttgggaagctgaggtgggaagatcactcgagcctgggggatcaaagctgcagtgagctgtgattgcaccactgcactacagcctgggtaacagagcgagaccctgtctaaaaaaaaaaaagaagaaagtgaggtcgaacctgtggctaacaaggggataatttacatgtctgagctcaagttcagatgtacaagttggattctcttttcttttttggggggtggggacagagtctcactctgtcgcccaggctggagtgcagtggcgtgatctcggcttactgcaacctccgcctcccgggttcaagcgattctcctgcctcagcctcccgagtagctgggattataggcacccgccaccatgcccagctaatttttgtatttttggtagagatggggtttcaccatgttggccaggctggtcttgaactcctgacctcaagtggtccacccgcctcggcctcccaaagtgctggtattacagacgtgagccactgcacctggccatcaaaattagaagtctttttaaaagtccctttgatcccacccatggtaggcaaaccctacctcaggcatcgggtcaggctgcaatttccaactcatatctgcttttagcccctggagatttcacttaaatcctgtgagctcagccatctatccccaagatgcagttcctccaagatacctggcaggcaccctggcaggagggtgtcacggttctctaacctggctgactactgagcctctgggctccatgaggacaggatgtctctctcactcgctgctagcccagtccctggcacagccctggggcttggcaaatatttgttgaatgaataaacaggctgtggcttataagctggttcagattccagctccccactcactccgcatggaagaatcacttcaatcctccaagccccccgttcttcatctgcatgggggatattttgttgttattgttgttttttaaacttgggatttttttttttttgaaaaatagaacagatacagatacaaaaaccacacagcataagcatgtgacttaatgatttattataaggcaactgaacaccctcgtgaccacctctaggtcaagaaatgtaactttgcctgccacccctggaaacccctgcagaaccctgtcctctcaaagccctgcccctcccaaaagtcactgctaccctaagtgttatggatatcacttgtgtttctttcttgttttaccaaccatgtgagcagccccagacactatacttaatcttgcccactttttaaaaacttgatgtctcttttagtttctattcctcctccatccctttcttttccttacaatttacctgcgcagtacctgggccatttaacctgcagagatccctgggtctgggttaggctgatgacagcaccgtgtcatggttcaacacgttctgtccttgggattttctgtaaaacggcagctggatcctgaggctacaccagggatgtttccaagcttctgccctcacgggtcgtggtgagaattgaagggggatgggtgagtgtttgatatcagcgagcagcccccagaagcagccgccaaggctgttcggagatgctcacgaggcctgaacatggacagcccgagggacatcccatctcaacagtccatcctggcttctctccccacccagacccacccaccccactttgggaaagttctagggccatggctggctcatcccagcgagagctggcagcagaatggcctgtaattttagctgtttctcttccctaaaattatttcccatctggaaatggtttcccaaccctgcccaggaaagagttggtggtgcaaggaacatttttctattaaaaaaaaaaaataggggccgggcactgaggcaggagaatcgcttgaacccggcaggcggaggttgtggcgagccaagatcgtgccactgcactccagcctgggcaacagagcaaaactccgtctcaaataaatatataaaaccagccaccaaacactgaatctttgcagcccaggctctggaggcctggctgagtgccagctgtataccctgccttgagggaactctgtcagcgaggagcagagggtgagagggcatagtcagggctctgctgccaggatacccccacccacccagtacattcggacaaggactttgttgcagggcctgggacagccccaggcgagctgagaaggatccgacctggggttgagtggcctgcccagctgctgccacactcgaggtctgtgggttattctaggtcccacagggcatgaaatcacagagcagaagttcttcctatggggattctcttgcagctgctctgagcatttcaagaaaaaaaaaaaatccctgccgctaacatctccccatcacctcgctaattctcttctttctttcctttttttttttttttttttgagacggagtctcgctctgtggccaggctggagtgcaatggtgccatctcagctcactgtaacctctgactccctggttcaagcgattctcctgcctcagcctcctgagtagctgggattacaggtgcccgccaccacacccagctaatttttgtatttttagtagagacggggtttcaccatgttggccaggatggtcttgatctcctgacctcgtgatccgcccacctcggcctcccaaagtgctgggattacaggcttgagccgccgaactctcttctttctaacaaagttctcacaggcccctgactcctgactgtgcaagcaagagcatctggcaagaatatcatgatattttttagcacttcttgtacttattttcataattttttttttgagacagagtctcactctgtcaccctggcttgagtgcagtggcaccatctcagctcaacctgcaacctccgcctcctgggttcaagtgattctcctgcctcagcctccttagtagctgagattacaggtgtgcaccaccatgcctggctaatttttgtatttttagtagggacaaggtttcaccatattggccaggcagtcttgaacttctgacctcaggtgatctgcctgccttgacctcccaaagcgctgagattacaggcgtgagccgccatgtccagccttattttcttatttccttttttttttttttagacggaagctcactctgttgcccaggctggagtgcagtggcatgatctcggctcaccacaacctccgccttctgggttcaagcgattcttctgcctcagcctcccaagtagctgggactacaggcatgcgccaccatagctggctaatttttatatttttagtagagttggggtttcactatgttggccaggctggtctcgaactactgaccttgttatctgcccacctcagcctcccaaagtgctgggattacaggtgtgagccatcgtgcctggcacccagccttattttcataactgttttcatgataaatgatataggttttccatgtttgctaatgatataaagtttcctctgcagaaacaggtttaaagaaaaatgtgggcagaaagtccgtttaaaatatatattaaggaaaataaaacacagatagcacaaaatccaaagctacctggagttttggtgcctggagccatggtgaagagggcatactccagatctgagggcccaggcttgcattctggctgtgactctgtgggccctgtgattttaggcaagtcacttgccttctctgagtcatggtgctttacctgtaaaagaaaggaaaataataacacctccttcctatgatgatctctgagaattcaataaaacaatgctgagaagacactcagcccagtaccaggcacatgggttgcatttaattctgtcagaacacaaggtgggtgctatttttattcctgttgggaagctgaggcccagagaggtcatctagcccatccaaggttgcacagcttgtaggtggtggaggtggaactagaacccacaaagttctaatgtgagactgggatttgtgctcttaaaccactgtgctgctattggcagatccatctatccacccatccatctgtccgtccatccatccatccatccatccatccacccacccatccatccatccacccacccacccatacattcattcatttggtcagaattcatggaattgttctgagttcatggtgttttctcaaaaagcagcaaagtgcagaagttcccagagtaggttcaaatcccaacctgccatgtacaggacacctgggcaagttgtcccacctctccgagcctcagcttgcccatctggaagaggggaacattgatagccctttgaaattcccgcaggaggtagaagactgttttctgggacttcacagtgtcctacgtgccctgcatctgaccccatggtctgcgttcacctctaagtctcagtgaatcaagctccgccatatgtctgcctcatcctgcctccctcctccctttcactccaatttagccagactcagccattggggttccctgaacagcccctgggcctttgtacactttgttcctccagcccgaaatgtcctcttgcttccatctggtaaccatgattcctccctgaaaaatcaggtgggcttccccctctgccccaggagcatcccctgaggctgagccaagctctgcctttctgggctcccccagctccccgcttctctgacatggaaaggtcatggatgtaataacttagacaaactcttgtgctctgccactgtccaccttcttggtcacaaatgtctgcttcccttctttcatgcaggtacatgcacccctctgcaaacgagtccacacacatgtttttacacaatcatggcatgtgatccgaaggcatgagatctgccttcgtacatgcaacatgcaatggtggaacggcattacctctggctagtgacctctcctggactcagctatcacctctgcagaaagggggcagtaacaggacctgccgcacatctgctgtcatgaagaccacatgagctaatatatgtgggaagcccttagcacagcgcctgggagagcataagcgctcgatgcaaggcagaagaaaggcgtgtcctggtgtgacagggcccttccgaccagggctggtactaaggtgagaaaagcgaggtgcctaccgtgcaaaatgtaaggcagcgttcactctcagagcagtgcacctgccgctgggtcctcggagccacagagcagtcccgctcgccccctgctggtcactctgcagaatgacgtcccttccctctgctctcaggggtccctgagcctcggtttcttcacctgtaaggtggggtaggagaatctgcctctcagtttgcagggcaaacaggaggcactcctccaacatcagtgtcctcctctcaatgccagcacttaatgagcacctactatgtgcaaagaaagatgactgagacatgatccctacccttcaggggtttagcgagtggagaggggaggaggtaggctgggaacagtgactaaagtaagacacttgtccctatgcagcacctactgcttaccccagagcagtcagaaccactgccctggcatctgtccatctgcatatgtttactaagcacctactgtgtgcctgagcccaggctcagctgtggatttacatggattaaggggtttaatgctgtcagaacacaaggtgggtgttctttttattcctgttgggaagctgagggccagagaggtcatctagcccatccaagcttgcacagcttgtaggtggtggaggtggaaccagaacccccaaagttctaatgtgaggctgggatttgtgctcttaaaccgctatgctgctattggcagatccatccatccacccatccatccacctacccatccatctatccaaccatccatccatctatccatccatccccatccgtccatccacccacccatccattcattcaacaaatattcgttgagcacctactgagtgccagacacagtgctgagtgctggagagatgccagtgaccagaaagacacagcccatccctgcccccagcagctgttcacaaagagaggatgggcaataagcaagacaaataagtaaaatatatggcacttggtgattcttgctgtatataaaaatagagtaaaagctgtgcacggtggctcacacctgtaatcccagcactttgggaggctgaggcgggaggatcacctgatcccaggagtttggaaccagcctgggcaacatagcatagtacagaccctgtctctactaaaaacacaaaaaattagctgggcatggtggctcatgcctgtagtcccacctacttgggagactgaggtgggaggattgcctgagcctagtcgagatcgaggctgcagtgagccgtgattgtgtcactgaactccagtccaggtgacacagcgagaccctttctcaaaaaggctgggcgcggtggctcacgcctgtaatcccagcactttgggaggccgaggctggtgaatcacttgaggtcaggagtttgagaccagcctggccagcatggtgaaaccctgcctttactaaaaatacaaaaattagctgggcgtggtggcgtgcctctcaggtactcgggaggttgaggcacgagaatcgcttgaacctgggaggtggaggttgcagtgagccgagatcgcaccactgcactccagcctgggtgacagagcgagaccctgtcttaaaaaaaaaaaaaaaaaaaaaaaaaaggcagcacagaagactgagagggtggggctggagtgtgtttcaattttaaattaggccttgagggccattgagggaccttggctctcattgtgagtgagctgggagtcatggagggttctgagcaggggaggagcctggcctgacttaggcccttgcagaatcactccaccaggaggccagagtgttaggacccagggtggaggctgcgagctcggggaggaggtgaccgcacacaggatggcggctgggcttggcggggcagtggagtggggagacagagtctggatgtatcctgaaggtggaacagacaggattagctggtggatgggacatgtcggtggcagacagagaggagtcggggatgaatgactccctgagcctctggggagggtggagctggctgcccttaaggctaagaaggctgtgggcagagcaggtttctgcgggagatgaggagtgggttgcggatgcattcaccctgagttgcctggcagtgtggacgtggagtttgggtttaccctcgtgttgacaggtacacgctcgcggtgcggttatcacgctgctgctggtgtcaccacgcgggcgctgcagggacggacctttcccatcgccaggctcttcggggactgctgcaatgccccgtgcagccgccagggagcgcccgagccgcacccaggacgcgcggggaccgggtcatcccgcgggctacctgtgcggggcaggacgcttagccgcacccttggcctccgactactcggagtctgttgcattcctccttccccccgcgcgccgtgtgacagccaaaactgtccccagacattgccaggcgccccctggaggggaaagtcgcccccacggcagtcagagccatggcctgcgcagccacattcatttactgagcgcctactgtgtgcctgcgtctgggctccgcaggggctcacgggggtttctccttttcatccaggtttctgttcagatgtcaccacctcagaaagaccctgtcctagacacgctccattcaatgacccgaaaggatcttgttgaaatgttaacttattacatttttgggtttttgttgttgttgtttttggttttgctttgagacaaggtcttgctctgtcacccaagctggagtgcagtggcacaatctaggctcactgcagcctcaacctcctgggttcaagtgatccttccacctcagcctccaagtagctgggaccacaggtgtgcaccaccacacccggctatttttttttttttttttttttttagtagagacagggtctcactatgttgcccaggctagtctcaaacttctgggttcaagtgatcctcctgcctctgcctcccaaagtgctgggattatgccactctgcctagccttctttattgtctgtctcccctacccagcagacaaacccctgccctcttagagtgcaacttccagtgagccagatggtcacctctttgaagtggtggcatttgagttgtgccttgaaggatagaagctgccgatcatggcagaatttgaagaaaggtctttcctggcagagggaaaagtcagggcgaaggcctaggggctgctcaagtccctgccttaaggcatttagagcgtcctgcccagtgggtgatgggtccccaggccacacacagctgctggccgagcgccccaagtcatcaggaagccatgtggtgtggacaagggccaggcagcctggacacacaaaggcccattgacagctgcatgggaaaagtccagggcacccaagccggaagcccaaggctggtccctcttgtcaactcccaaggagctttgggtggggacaatagaaaagccagaccttctcaggagactcaagtttccctggggtggggcaaaaatgcaggtggcctggtcactgggacatgcagggcagctgtgtgaggcttttgcagtcccccagccctggttctaagtctagccctgccccctgctagcagagtgaccttggtcatgtcatgctccctctcagaccctaagttccctcatctctaacacagggtgaaagctgggtgcagtggctcacacctgtaatcccagcattttgggaggccaaagtgggtagatcgcttgagtccaggagtttgagaccagctgagcaacatggtgaaacctcgtctctacaaaaaatacaaaaattagctgggcatggtggcacacgcctgtagtcccagctactcgggaggctgaggtgggacaatcacttgagctagcaaggttgaggctgcagtgagcgaagatcacgcaactgcactccagcctgggcaacagagcaacactcagtctaaataaataaataaataaatacaatggggtgaaaaatagaagcaaccttccagcaatggtgtgagactgcctgggtagagtagtgggaaccaggcctgattcagcaggtgtttaagagcaggtggtcagttccagcagtcagctatagtggctggctggagtggccatctgtggcggtcagtagtggtggtcggtcatagtagtcaactttcatggtcggctatcacgacactaagcatgaggaccgtcaggtgagcatggctggggtgtttggtcagacagacctgggttccacaggtctcctgctttccagtgtggggcagatatgatctcctttttccaagcctctgttcctccatctgtaagatggggataatgagagccctacacagggcaatgactgtgaagcgcccagcactgggattatagaatgttccagggctttggagggcagcctcagaagagcaggccaaggaaagcgcaggcctcccgactgaaggaggtctgcagagccagcaggtaaagagtggctataaacgaacaggagctgggcctccctccgcgggcagtggggacgcatgagggcatgttcccagcctgatagcaggaagcatttctggaaaagcccagctgaatagtgaagatagcagagcaggaatgtgaagaacgcagacctgggatcagcttgctgggctcaagtcccctgtactagctgtgtgtccttgggcaagttacttgacctctctgtgccttggtttcctcatctgtgaaacagggataagatcaacctaactaggctatggggttgatgtgaggtcctgatgagagaatatttctacaaagaatgacagataggctgagggccttaaacgatgacgcaggccaggcatggtggtgtgtgcctatagtcccagctactaaggaggctgaggtaggaggatcgcttgagcctgtgaggttgaggctacagtgagccgagattgcaccactgcactccagcctgggtgacagagccagaccctgtctcaaaataaataaatgatgttggactgagaaagcatcaacactcacccaggctctggggggaaggtggatgtgagcaaggccaggaagagccaggaggaataggaggcaacccctgtatgtttgtgtgagcgcagccaggtgccagggtcgggggcggcaggagcagaaaccctgagaatgtaaaacaattcagcagcggccgggcacggtggctcacgcctgtaatcccagcactttgggaggccgagacgggcagatcacgagatcagaagatcgagaccatcctggctaacacggtgaaaccccgtgtctactaaaaatacaataaaaattagccaggcgtggtggcgggcgcctgtagtcccagctactcgggaggctgaggcaggagaatggtgtgaacctgggaggcagagcttgcagtgagccgagattgcgccactgtactccagcctgggtgactgagcgagattccatctcaaaacaaacaaacaaacaaacaaacaaacaaacaaaaaattcggcagcagtggcaatggcctcagggactctgagagctactaacacagccacctggacccacataggaaaagcaagcattctgagatcggaagtatgaactttggcctgggacaatagggagccactgaaggtttggtagtcaagggtcagcccctcttaccctgagagttgatataactaggatactccacagcttcatccccagcacctacctcggggcctgcaacatagtaggtgctcagggaaatgattttaaatgaagaaatgcattaatgggtgaatgagaaactggctactaaaagctggccttattttgcccttcacccacatagcactgggtacctccagggacttagatacagagggaccagcaaaggtaaatgtccggagtgggaacaagctcagggagacagaggagcagtgaggaggccagagaggctggagtagagaaaacaaagggagaacggggaggggaggccccgcggaggtgagccggctggacctctcaaggccttgcgagtagggaatagcgctttcttccaagtgcagtgggagcctccagagggtttggtggttgtgtgtgtgtgtgtgtgtgtgggggggggggggtttgtttgattggtttgttgttgttgttgttattgttgttgttgtcgtcattgtttttcagacgaggtgttgctctgtcacccaggctggagagcagtggtgcaatctcagctcactgcagcctcgacctcacaggctcaagcgatcctcctacctcagcctccagagtagctgggactacaggcacgcaccaccatgcctggctattttttttattttttgtggagacagggtctcgccatgttgccagggctggtctcaaactcctggactcaagcgatcctcccgccttggcctcccaaagtgcttggattacaggcatgagacaccatgcccagacagttgcattttaaatcctcctatcaaagagcataggcattattatccccatttcacggatgaggaaactgatgctcagagattgaatgatttacctaaggtcacacagctacgtagagacagtgccaggattcagcctcagcccattgggctgtgggatctgcagggctggaggggatagaacaatgccagctggagccagcactgctccccatctgctaagctctgccctacgacctctaggtgacactgggtgttggcaggcatgaaggacctacaccgtgggactgtggggaacacgaccaggccctgatcagtaggtctgctgagtcaccaggcctggcccagagctaacctccggcagccaggagccgccccagggtccgtccttggtgccctgcccagcagctgccaagcacagccactgccacatgagctggatgtcctgcagaagccagagtgacaaactacccccaaatctgccctcctccctgtgctgtgtggcctctggcaagtcccctgccctccctggcctgcggtgcacctgctgtctcgtgcaagccccaggccgcagtgcccctccctttgtgctgggtagaatcctggccaattgctgataccgagtttagaccggagggcagaaaggcgggacaggtaagtgcagacagtggggaaggctgtgggccccacaggactagactcttgtgggtgtggcggaggacaaggctgcccatcagagccccaggggcccaggctccacccaggtaacaggacacaagaagagagagcctcctaagcagaactcggtttctataagcaagacagatagatagggcaagccagctagcatttattgagcacttaatatgtgctaggcattctacagctattctcttacttaatcttctcaatagcgggtgatgatcatgatgcatggtgattcctgttttgcagatgaggaaactaagacctaaagaggtaaagtccttgctcaaggtccccaagccaggaagtggcagagccagggtgaaatccaagtccttgtcattccagagcctctgcctggacctggaagcccctcagactctaaagctctaatccccccccaacccccccagcaaagtgcagcattcaggactgagcctcaagggaccagccaggtctgattgtgaacctcagagcaaggcaggattgtcagtgcagtaacgtgagactggtggggcctgatggcctccttggggacagcctgggacaatcgcaaacagaagctggctctgtgctggagcttgccctgtcctggggacctctcccacccaggacgagctcacctcaacatgtaagtcacctgggacccgaggagcccattctagggatgtaaaacctgaggcccagaatgtccctctaacgtgcccaaggtcacacagagagtgagcacacaattggtactactggaacccagttgcctgtcttgtgcagcctcagtttcttttcctcccgggatctcctgtgttaaaaaaaaaaacatacaacgtggccgggcgcagtggctcatgcctgtaaccccagcacttagggaggccgaggtgggcagatcacctgaggtcaggagttcaagaccagcctggccaacacagcgaaaccctgtctctactaaaaatacaaaaattacctgggtgtggtggtgcctgcctatagtcccagctacttgggaggctgaggcaggagaatcacttgaacctgggaggcagaggttgcagtgagcccagatttcgtcattgcgctccagcctgggcaagagagtgagactccatctcaaacaaaacaaaacaaaaacaagaacaaaaaaacgcacagtgtactctcttgaccctcatcatcttccaacaagcaccctggtcctccgtcccacctaaggctgaacttctggtggaagctgtgcatactcccccacccactttcacaccccgccaccctcctcaccctgcaccctcctcacctcaccccctctcctcaccccaccctctccacaccccaccctctccacaccatcaccctctccacaccatcaccctctccacaccccaccctctccacaccatcaccctctccacaccatcaccctctccacaccccgccctctccacaccatcaccctctccacaccccaccctctccacaccatcaccctctccacaccccaccctctccacaccatcaccctctccacaccccaccctctccacaccccaccctctccacaccatcaccctctccacaccccaccctctccacaccatcaccctctccacaccccaccctctccacaccaccaccctctctacacggccaccctctcctcaccgccaccctctcctcggtgcccttgagcaggccttcatcccctgtgtcaccaaatggctcttggtgttgtgatccttgctgccaagtcccagtgtgggatcccgtgctcagagccacttctcagcaacgtttgacactattgacctccctctccttctcgaaacatccttcttgaaacagcctctattcctgacactagatgctccatgggccctgcctctcctcctcctccctggcagctccaactcagtggctttaaacaaacatgtgttctgatacatctcagactcccaacagcatccttgatctctctccagggctctggacttgaatgtcgagttacctacttgaaatatcctaaaaacacagcctggttccccacaaagacttatttcattcctccttccttatctccgcactctccagtctttgttcctcagtgacaccaccctgtagctcaagcatcaaagtgacgtatcattctcaagtcctctgtttccctcccaccacctccaaaatttgtcctgagttttccatttctctgtaaccccatggccaccaccctggtccaggctgctaccgtcctcacccttgacctccttgctgtttctttttggggtttttttttttttttttttttttttgctgctacatttgcttcccatgctgccgggggaactttcagaaacataaatcaaaacatgtcacttgcctgctggaaaccttccagtggcctctggctgcctttccaaagactcccaagtcctcacattggcctacaaggccccatcttcttctccagccttccctcctcccttcctattcagccacattggcttcctttcatgttctccagcaagccaagttctttcctgcctaggggcctttgcacttgctgtttcttctgtctgtaactctcttccttctgctcttcctataactgcctctttctcttcttttaaagcccagctcaaccatcacctttccagagatcacttccctgatcatctaattgaaggacctcacccttcaccctggtcactctcaaccctatcatcctgtttattcccttcataactcagcaatgtcgggagctcacttacttgttgacttgtttattgtctatccacctctcttccccagaatgttggtcccatgaaggcagggatttaatatctttcttattcagtgcattagatggaaaccaggtacacacagcacagtgcctggcacatagaaaatgctcaataaatattggatggatggatggatggatgagatggatgaatgaatggatgggatggatgggatggatggatgatagatggatgggatgaatggatggatgtgataaatggatggttgagatgaaccgatggatgaatggatgggtggatgggtaatgaatagctggaatgggtagttggatagatggatgatggatgggtggatgagatggatggatagatggatgatgagggatggatggatgagatggatggatagatgggatggatggatgggatgaatggatggatgaaatggagggatgaatgaatgagatggataggagggatgaatgaatgggatggataggatggatgaatagatggatgaataggtggatggatgaatgggtgggtgggggatggatggatagggtgaatggatggatggatgaatggatagttggatcgatggatggatggatggatgaatgagatggatgggatggatggatgaatgagtgggatggatgagatggatggatggatgaatggatgtgtgggtgggggatggatggttgggatggatgaatggatgagatgaatggatggatgagtggatgacatggatggatggatagatggatgggatggatggatggatggatgagtggatgggatggatgggtggatgaatggatggatggatggatggatgggatggatggatggaaggacggatgggtgggtaatggatagatgggatgggtggatggataaatggatggatggaatggatggatggatggatggatgagtggataggatagatggctggatggatggatggatgagtggataggatagatggctggatggatggatggatgggatggatggatggatggatggacggatgagtgggtaatggatagataggatggatggatggatgagaggatgggatggatgggatagatggatggatgggggatggatggatggatatgcaaccagataaacaaacctaaagtacacctttaatcatgccactctccttctccagaacctaacttggctgcccactgcctatggaatagacagcaaactctcctctgggacattcaaagcgttctgaactgattccaaagtgggggtgcagtgagtgataagtgagaagataagtcattcatactgaagcattaggaagtggatcagttaaccatctctctccttgatctgggcatgagccatttgagggcagggtcatcttcatctctctgtctagacattgagcccttggtcagcaacatcagagatgtctgatgaataaatacatgactgagtgagcgagtgagcaagtgaaagcagccccactctgccccaaaaagccagcaagcgaaaagcaggaagcttcagacccagagggctgaacagttcaaatttagaataggagagcagtttcactgtttcaggtcactgctcctggccaaggtttcaaaagtatgtaaagctggggctctgcagcaacaggaaaattgaaacttaccagaaactagactggcagtgtctctcgggagggactgatttgaatgccaatgacctgatcctccaattataagagcagcacagtgtcagactaaaaagcacactcccacgtaattgcaaccaaagccacaaagactcccacaactaagagtggcacttcttcagtgtcccgtcctgctgacacacttttggtttttgcagaccttgggcccttccattgtgactcttggtttgcaggtggaagaggagcagagctgtgaagaggagagcttggggtcacctcagctctgccagaggttctgtgacctgccagaggctctgggaccttccctgagtcatcatctgtggagaaaggacttgccactgagtggtgtgttctacttgtaccgctcttctgatcgatcagcgtctttgattgggttccctgggaaacagactcagagagctgggcacgcaggtggtttactggggagtgctctcacgcacagcacctgtgaagggggtagagtggtgtggggggcagtgatgtggggctggaatgcaggcacaccagaggcctcaccagagctcagaggctggaacagcccttctgagttgcctacatcaggaccatgaaatggggtccttagacccccatgtcaacccgacgttggaggtggcctgcccctatggaggaggcagtcttaggcaaggcgattctccttggctgaaggcgaatcctggagcctctgtcctgaaggagaatccaggtggcagactacaatctccactgaagtccactcctcttcacttccaccgcctggagccaacccatcacctctcatctggatgcagccttaagatcctccccagagctcagcattcatgcttggcccttcaccaacagagtccaatctgcaccaggaacccaaagccacaggaggtctcccagcacagaaatcagatcacttcacttcactgcttgaaaccctcaaatggcctcccagaacaaaacacactcagaataaaatcctgagtgatccctgcctctgcctatgacctctcccttcactgtgcttcagccctttctctctctctctcttttataacaatccatcatgacgttcaatgttctctttttcttgagacagcagctgtgttccaccgcagggcctttgctcttgttgttcccgctgcctgacgttctcttccctcagatcttcccatggctgactctacgtccttcaagtttcatctgacacgtcacctcctcagagggatattccctggttatccgatctaaagtggttccacattcctcgcacgttaccttccttttaaaccacttctcactgtctgaaactatcttatgactttactagttgacttcctgtctccttccatcagaataaactccgtgggggtaggaatcacatctgccttgttcaactctgttacctgcagcctctaaaccagaaaccaatgcgttgtaggtgttatctatttgttgaatggcttaataatgatttcatgattctgtctccttacttattgctaatcttgctctttttactgtttgccttaatcaatcagatttgtcaggatttatctgtcttcaggtgctttctttttaaagaacacctttttcactttatttatcacttctactttgttttttctatttcattaattgcatagtttacctttaatttcttattcctatccttttggcttcttatattttctattttcttaagttaaatacttaatccactttgttttcaatttttaaaaataatagacgtctttaaggctatacattttcctctgtaggcagcattagctatgtctcacacactttggtatgaacagtgtctgctttttaagactctagataagtttccatgttggttctgattttcctctgattcaggggccatttagaaataatagctatttttcaagaagttaaaattttgaggttgcttttgataatttattctgaattttattggattatgaaatgagaatgtggcttggaaacatctctactttgcaacttcactttgccatttacaaactctcactagaccagagtttccttgctgagcatgtttcctcatctgtaaagcgagcacaataaacagtggctacagatttatgccaggtgtggtggctcatgcctgtaatcccagcactttgggaggccaaggcaggtggatcacttgagatcaggatttcgagaccagcttggccaacgtggtgaaacctcatctctagtaaaaatgcaaaaattagccaggcatggtggtgcacacctgtaatcccagctactcaggaggctgaagcaggagactcacttgaacctgggaggcagaggttgcagtgaggtgagatagcaccattgtactccagcctgggcaacagagcgagactccgtctcaaaaaggaaaaaaaaaaaagagtttctatggccacctgggataggaggcttttcttgaagccactttaccctaataaacccattgtctttacttatgttgtatttatatctgcagcggccttgatgctgtcactgaccactgggacaccccaggcctgacaggcagctcctgacaccaactcaaatgctagttccgccgggtgcagtggctcacgcctgtaatcccagcactttgggaggccaaggcaggcagatcacctgcggtcaggagttcaaaaccccatctctactaaaagtacaaaaatcagccaggtgtggtggtgtgcacctttaatcccagctattcggaaggctgaggcaggagaatcacttgaatctgggaggcagaggtggcagtgagccaagattgcaccactgcactccagcctggatgacagagcaagacttcatctcaaaaaaaaaaaaaattattttgctgagagaaatctggactatacattccagctgtgaccaacttatgacactgcagctatatttttattagtcagtggatctaaaaccaaaaagtgtgaaaaaagaaaaatttctcaatgataggcaaacaaatcttaatatgtggtttattactttgtatttggttccactgattattctgtcaacaggaatgttagtggccttgccaccagcaaggttggcaatcttggctcccagttacttctcttgtaggtcggtcttaagaacaaggctttggccaggcgcagtggctcacgcctgtaatcccagcacttcgagaggtcgaggtgggtgaatcatgtggtcagaagttcgagaccagcctagccaacatggtgaaaccctgtctctactaaaaaaaaaatacaaaaattagccaggcatggtggtgcgcgcttgtaatcccagctactcaggaggctgaggcaggagaatcgcttgaacctggaaggtggaggttgcagtgagccgagatcgcgccattgcactccagtccgggtgacagagcgagactctgtctcaaaaaaaaaaaaaaaaaaaaaaaaagaaaaagaaaagaaagaaagaaaaaggcgttaaggctttaggattggatgtggtggctcatgcctgtaatctcagcactttgggagactgaggcaaggggctcacttgaggtcaggagttcaagaccagcctgggcaacatagggagacctcgtctctacaaataacttaaaaattagccaggtgtgatggcgcatgcctgtagtcccagctactcgggaggctgaagtaggaggatcacttgagaccaggaaattgagcctgcagtgagccgagatcgcgacactgtactccagcctgggcaacagagcaagagtttgtctcattaaaaacaaaacaaaacaaacaaacaaaaaaaaacagacaacaaaaatagcaagagtactttagatttatagacggtgctttgcagtgaagctgccatgatgaaagcttccattgaccgaccacctgtcgtgtgtgaagcattgttcttggtaactcacatatgttgctgcatttcctcttcacaataacttcatgtggaaagttttaccacctcccttctccaaatgagaaaacagtataagagaaatgtgactttaccaagagcacccagcttctgagtgggttcagcctgggggtgtctggctcttcctacatctggaatcttcagattgagaaggttcattgtcatttactcagcaaatatttgagcatctgccccttgccttctgtcctgcagtatgccgaattctggactaggtgctggagatggaacagggagcaaaacagcgtcctttgtcccctgtcccagttgggaagaaagacaaagaaaagacaaacaaaacaaaacaagacgaaaacagcacttcacagtatatatgatgttagagagggacggggcagctaagattctcaacagttcatttcagtactaaactgttttacttctattctgtttcttttcttttttctttttttctttttttgagatggagtctcactctgttgctcaggatggagtgcagtgtcgcgatctcagctcactgcaacctccacctctcgggttcaagcgattctcctgcctcagcctcctgagtagctggggttagaggtgcccgccaccacacctagctaatttttgtgtttttagtaaagacgggatttcaccatgttggccaggctggtctcgacctcccaacctcaggtgatcctctgcctcagtctcccaaagtgctgggattacgtgcatgaccctctgcacccagactctattctatttctgtcatcaggcggattgacagacacaaaaatgtagtgtctctattgccctagatctctttagccatgtccgaggaccaaggaatgtaaaatttatttgtttttgagacagggtgtcactctgttgcctaggctagagtgcagtggtggatcctcccacctcagcctcccgaatagttggaagtacaaacgtaacaccatcatgcccagctaattttatatatatatatttgtagagacagggccttgccatgttgcccaagttggtcttgaactcctggcttcaagcgatcctcccacctcggaatctcaaagtgctgggattacaggcgtgagccaccgtgccgcccagcccagggttctgttgtaatgagcgcgtccttcttgtggtgtgtcctttcttcacttgcagtcttcactcacagccctgccatttcttgttcctgtgtaatctgtcactttgtggcacttccttttcctctgtgttgacagagcctggcttgtttagccactcttgtgtcctcagggggtttgatttccttccatgttattgctattatgtgttacatagcgatgaactagccaggacacattgttatttttcccctggtttgcctccctgttcgtaatcctccgtcaccgttcacatttctattgattttcagccaaactcgggggttggcaaattacggccacccacctgtttttgtaaataaagttttattggaatgcagccaagcctgtttgtttacatattgtctggggctgcttgagctatgagggcagaattgagaagttgaatagctgagtgacagagactgcatacagcccctgtgacggtggaaaaaacaactgtttttcctctgctctcacactacagcaatcaacactaaagactttttttttgagacatagtctcactctatcacccaggctggagtgcagtggcacaatctcagctcactgcaacctccgcctccgggttcaagtgattctcccacctcagccgccagagtagctgggattacaggcacccaccaccacgcctggctaatttttgtattttcagtcaatatgggttttcaccatgttggccaggctggtctcgaactcctgatctcaggtgatctgcccacctcagcctcccaaagtgctgggattataggtgtgagccagtgcacctggccacagaacatctccatgaccaaatgtgtgtctgtttttccccaagcaccaagcagtggacaccagcggggcatcccccaattccactccgatgctgtctacctgaagatagcctcgggtcacacaggttgagggctcagtccccaagactgtcccctccttcccaccagtcacaagtccaggcttccagaacttctgaccgatcagctccaaacccgctctttgggtttaatttatttgctaaagcagctcacagaactcaggcaaacttacttttacgtctactggtttatgacaaaggttcttttaaaggacgcagttaaacagccagatgagacacacacagtgaggtctggaagggtcctgagcctgtccccatgccaccctcccagcacgtggatgagttcttgttcaccttcttacaaacctccgtgtgttcagctatctggaagctctctgagccctgtcctcttggcttttttttttttttttttttttgagacagggtcttgctctgtcacccaggctggagtgcagtggtgcgatctcggctcactgcaacctctgcctcaagggttcaagcgattctcctgcctcagcctcctgagtgagctgagattacaggcatgtgccaccacgtacagctaatgtttgtatttttagtagagaaggggtttccccatgttggtcaggctggtctcgaactcctgacctcaaatgatccacctgcttcagcctcccaaagtgctgtctctccatctgactgcaaggaaatgaagttgcagggaagtgaagtgacttccccaggccatggagttgttggctgtagaagtgcaaccagcagatcatctctcctgggccctgctcttcctagaattcacagtggaagatgtataccctactcccacctattccttacctccgagcctccctacacagcagagacctctctcctacatgactgccacccaccattgtcctagaaataagtcaaacagtggcatttgtcagtcccacatctagtcgtagcagggtgctgtgtggggcgggcgtggtggcagagaaaaggtgtgtcttggagcagtgagaaaagtactcagggctgtgcttcctcaaggagtctcatggcatgtagcctgcctggaaagttttctgccagcatctagcaggttgcatttcacaagcggcataaatcctccttaaccgtttgcccttacagctagtttgcatgtgatggtaaatctgaattgttactcagtgactgtatttattaagaacagcccacctgcaaggtactgtggcatcgagggtaccaggttaggaggaaactagcatttttttttttttagacagagtctcgctctcgttgcccaggctggagtgcaatggcactatctcagctcactgcaacctccacctcccgggttcaagtgattctcctgcctcagcctcccaagtagctgggattgcaggcgcctgccgccatgcctggctatttttttgtgtatttttagtagagacggggtttctccatgttggccaggctggtctcaaactcctgacctcaggtgatccgcccaaagtgctgggattacaggcgtgagccacagcgcctgacctcagcaaaagaatttggtaagtctagaggtaaagcttaatactgtaaagatgctaaagatgctgtcttcccagatcattaatttagtgcaatgtcagtcatgatcctagattttaaaaagcaattttttaaaatatagagacagggtctctttgttgcccaggctggtctcaaactcctggcttcaagtgatcctcctgccttggcctccaaagtactgggattacaggcatgagccaccatgcctggcccttaaatagatttttaaatataacttgacaaaataaatctcaccggattgagaaaatacataaacatagccaagaaaaacaatttttttgagtcagagtctcattctgtgtcacccaggctggagtgcaatggtgcaatcatggctcactgtagcctcactctcctgggctcaagtgatcctccagcctcagcctcgtcggtagctgggactacaggcacacaccactgcacctggctaattttttcttaaatttttgtagagacagggtttcactatgttgcccaggctggtcttgaactcctggcctcaagtgaccctcctgcctatgcctggctgaaaattttgatgagaatggggttgtgtaagtatgttcaccctgacaaaagagctgtttgctttggatttatggacttttctgtatgtatattacacttctataaatgtttacaaaatttggggtaggatatagaaagtagagataaacttgtcttataaaaacatactacagggctatcataattaaaactgtaaggcataataagacaaatagctcaatgaaatggaagaatcttgctacagaatttaatgtgtaagacatggggaaattattgattgttcaataaatactgttgagacaattagcaatccatttggaaaaaataaattatagaccgcccctcctgaccatatcatacacaaaatcccctttaattccaggggttaaagatataaatagcatgatcattcactgatggtagaaggattaattcatactgcctttttgtaggacaacttggtaggctccttcaacatttaaaatgtgcaggtggggcgtgatggctgacgcctgtaatcccaacactttgggaggacaaggcgggtggatcacttgatcccaggaatttgagaccagtgtgggtaacatagtaagaccctgtctctacaaaaaatacactaattagccaggtgtggtgtgtgtgcctgtggtctcagctactcaggaagctgagttgggaagatagcttgagcccgggaggttgaggctgcagtgacccatgatcgcaccactgcactccagcctggggtgacggagtgagaccttatatcataaacaaataaatatatgtatgtatttgtgtgtgcatgtgtgcatatatatgtgtgtgtgtgtgtgtgtgggtgtgggtgtgtatcccttgctccaacaatttcatttcttgactctctcaagttggcctacacatatatgtgcacatggattgatgtgcatctgtgttcactgtggtgcatataatgtgatagtggaaaactggaaactacctccatgtccattaggaggggaatggctaaattacatacatccacacaagagattaccatgtgtcacaattcaaataataagataggttcagtcattcatgcaacaaatatttattgagcaactactatgtgctaagaccagttcttagctctggggatagagcagaaaacaaaacagtctctgccttcatggggattatattttagtggggttgacagccaatgaacaaagaacaataaaaatatagtacgattcagagtgagaatattgtgaatcaataaaacagggtaaggggggacagggacagggaggtggcatttcagactgggtgctcatcaaatcttctccaaggaggtaacatctgggctttatttgagggagctcttcattcacggaaaagaggtctccagaaacattaagaaaaaacaaaacaaaacaaaagtaattacaggacaacttatggtttttaaactatgcctttgttttcctaagcatgcatataggtatacaggtatagatctggacatcagccaatggctggacatggtggctcacacctggaatcccagcactttgggaggccaaggcaaaaggacggctggagcccaggagttcgagaccaatctggacaacatggtgaaaccccatctctacaagaaatacaaaaattataaaaattagctgagcgtggtggtgtgggcttgtagtcccagctacttaggaggctgaggcgggaggatcacttgagcccaggaggttgaggctgtggtgagctacaatcgtgccactgtactccagcctgggtgacagagactccgtctcaaaaaaactaaaaaatgtagacatcagtcaaactgctaatattaaaggagtggtttaacacttattttccagcaagcacatattcacgttacttttagaatagacttttcaactctgtgaacaaaagctatttagagcacatatgcaaaagagttgggtcagcagaagcagcctaggggttaagagcgtcttccctggggcaaaaatgtccccagccggctcagctgctagctttgtgacctcaggcaagctgtggcttcagtttgtctagagtagctgttccatttgggtttgtacctagagggaggaggccaggggtgctgctgaacacccgacaatgagcaggacagctcccccatttgtcaagagcaatgtggagaagccgtgctccagaacaaggggcagtgcccgcctctcaagggttgaggactcacggtgtgcaatgcacttagcataggccctggcacatagcaagtactcaataaataggaactatttttattactggacttccctgaaaactaaaaaaaaaaaatgttgagagtatggaggacgtggtagtgccaggaatcagttctgctgaatcccaattccagcagctggctggaagggatctctgacctccacagcaacaacagtcttcacggggtgtgtgtctgccaatgggatggcctatacagagctcctcgttccttctgtttggtttttctggtttgaatctcatctcctgccagtagttcagggacattcccaccagatcacctggtctcttgtacgtattcagctgtgctctctcagacattccctgtggttcagaagaaacacactcaagcttctcttgtgggaaaaccaaaacccaaccccacctcacctcccacccccagcttcccgcgcttcctgtggccctgacctcctctttccaccccttcccaggaaatccaagagacacccactctgctgctatctcctccttccaccccatcaggtcagcaaaacggctcctgccacatttccaacacctggccactgccaactcactgcttctccctcttcctcttgtatcgcttctctgctgccttcagcacggctgaccactctccctcttggcctgcttgtcctcccacccctcctcctgctcactcatcctccttttctcaaccaggttctcagaggctgggccaaggctgctgccttctcttactccatgcttcctgttctcaatcccccagcaatctcacccgctgctgggtccttactaacctcctccacccaaagactccccagtctgcctgtagcccccaccctgctgtctctgccaggttgtctcaaaactccctgaactcagcagtcacaactgatctcgtatctatcccgccaatctggtctgactctagtgcccccatctcagggaatggccctgttacctgtgcaagtgggaagccagcagcttaggtggagtcctccatccccatcacccctggcaggtcctgggagcacgacctcagtatctcccagtctcccctcctccgtcgtccctgcacccatctcactcgcccctgcttctcttctgcttctgtaccatcgctcgttctccctgcaaccagagccatctctcaaagttgctatggaatccgaatcgcatcacgcagccctgcctgctgaaaactcttgaatccactgctctaaggatgaaatgcaaactcctccccctgtgcgcccccctgccccctctactccagccacgctggcttcctccctgccctgcagctgtgtgccacacgctccttgtctccccctagctcacttgcttccaccttccctacattcccaactggaatgcccaccctaccatgcactcgtcacctgcagcttccccttttggaccaggtattgaggatacaattttaatcataccccccagtggaccgtaagtttaatgagtccactgatcctgtcttattttctctattattatgtccccggcatctgacactattaatactgtgagtggcaaacattcaacacatagaagccatgatgacaatctctgagcagaatctggcatataaaccctacactgatcccagagaaccttctggaatcaaactccatcaaccctcaccacccccttcacccccaagtcccctcactcaagtgtcttatgcaactttcttggtaccacctgggtgattcttgaaagaaaacccaagcgtgggcatgcctgggcagcacagtggaggactgcttctgttacactgcgtagctttttactcagcccgttcacctgcagcacgggtcaggcagtatttaccccagcaagacccagagctcagctgagctgccttaagttgaactcctgtaggaaaggaaaggaaaaaggaaagacccccaaggacccaaactgtcctacacaaagagaaatgaccaccaaggtttggttcttgaatatgtattttttactgaaaaaatcattcataaattaacatacaaaaatgtacaaacacatgagtaaataatgtaatgacaaaggactatttttgtgaaaagtgttttttaaaacatctttagatttcagtgcaaaaatgtacccctggcacctcttaaaacgtaagagcaagctcaaaaacacgtagtgatggaaataagctagctacgctcaatgccatcgtcaatggtgagtggatacaatcaatccatgtggctcctgctcagctattaatgtctgtggtagaggatctctgacaagaggacctattatgtcaaaatgagtattcttgcaaatacccccccaccccccaaaacagcatgaacaaacggggacacctttccctgcacacagcaatcaaagacaagattaaggggccacccatcagtagccttgaagattttcagctaccaatatatgcacaaggtcacatttggttcctgtttttttttttaacatgacaatttcacactattaacagcacacgggcctggctgtacgtttttaactatgacatttcccatatgatattcgaggcctggtggacacatgactgacagtgcacatccagagattctacactcatcagacacagacatgaccgcaaaggtatcaaagtgaccccactttaagcagtgaaaaaagacctttccttttgttctcaaatcagcattttctaaagtcaggtgttagccttttgccaacagtgtgtacttgatggtaattatggcaacatagagcttcaaacaagatcgcctgacaacactgccgcatacacatacggcacccaggactcagaatcagtctgtcctggcaaatccttccaaatgacatcatagtgttgtcacattgaaagcaactcacagccttcagtgaggaaaggggagaggagaatgagaaggggagaaaagccaaggcagggacaaaggcccggtgggggatgggggttgcagggtggaggggggtctttattgctatatgcaccataaaacaaaggaaaaccaaatgaacttctgtgtgtaatgttcacttgtgaaggtattttaaagcatgaaatgcttaagtcttaaaaaacatatgctatagcttaccggcattttcaagggcaggaacctgctctctcatatgagccgataagagctttgcaatgcaatttattttctaaataccactctattcttcaaaagaacaaaaacacaaacaaacaaacaaacaaaacaaggcctggccaatcactcccacagtttgtggggatcatatgtccacagaaccatcacatgcaacgaaaaaagccctaacccacacacatacacacacacacccctacacacacccatgtaaactatgaaaatcaaggaagttgaaggcaaacaaggcaattaaaaaaaaatacgaagtactcttcagaaagtactcctcatcacaatatataaatatgttttatggaaaacaagggcgggggaggaaaactggcattttccagaattctgcagaagccgacagagactacaatttgagggctttggtttggggaaaaacaaagaggcacaaattcaaatacaatttagaacatgacttcaaggctgggcgcaatggctcacacccgcccataatcccagcactttgggaagtcaaggtgggcggattgcttgagtccaggagttcgagaccagcctgggcaacatggaagaaacccctgtctctactaaaaatacaaaaaattagccaggtgtggtggtgtgcacctgtagtcccagctactcgggaggctgaggtgggaaaatggcttgagcctaggagatggaggctgcagtgagctgtgatcgtgccaccacactccagcttaggcgacagagccagaccgtcttaaaaaacaaaacaaaaaataatatgacttcaaaatgcaggtgggggtgtgagcagtgcacctgggctcttgctgtctggagctttgttagtctaatttcaaagcttcaatccggtcttacctggatcccagctgccccacagcacacaagtgtcaccagctccctggctcctggctccctatttgagtgctccttggttctatgtatcagttactaatgttgacaaagaatctttccagaaaccaaaaagggacacagaggaatcactgaagccagctggtaatgtaggcacattgttcagaaactgtggccaagttccacaagagaaaaagtaagagggggagggattcccatacacacccccgccccccgccccccgccccgccatgctgatgaaaagacagaacacgaagcctggagagccagagatgtgtgtgcagcgagccccgaagggcctgctttaggcaggaagcagcctgctctaacagcagcctcccgcttagcggagagtgggatgagcacatgcgcggccgacagggaagagtgaatccagagcagaagtcaagggcaagactcgtgggggggggaagaaagggacagaagccagctcccagcaataaaggtcgggttattttgttcttttgtgacatgccctatatccactccctcgccaaagtgacagcaattcgggagatgacattcttcaactgcattttaactgagttcctgcacttgccaaccaagtaagtggcctaatacataaatcctcaatttgaattggagccagctagaaaattaaattttaaaaaggcattttacatggcttatttacaattatacttcttcaagaagtgattgttatatatttatgtctatttatctttcccaaacaccctcccctccaccctcaatccccacccaaagaaggtaattttttaaaaaaatgaaaccaaagagaacaccagagatctagaagaatggtgtggagtttcatttgctcttcctaaaacgcagctgccctgtggtgggtttgcctctgctctgaaggccaagaggctccaaggtcatgtgtagggacaggctccacggcaggaccacggcaggaccacggcagatcacagttcatcatgggttctggagactgcggctaagacaggatgtggggtaggagatggggagagagcagcgggacagacgtctgtcttgtgaaaacagaaagccagtgctgacgaaggaagtccccaagctcactccctcagttccagcggctgatccagtgaaggcgtttgtgcgtgtgctgtcacattttccccctgaactctgtgatccttcatgagacacagtatttctgttctcttgctgtgtagaccctcccccctccaaaaaaaaatctcatcggactgctttcttggtggcggtgggtaaagcaaacgtacattctctcctctcagtactcgttcacctgagccagctcgggtgtcaggttgacagttatgtttttatacaaggcgtcgtatgtgatgtttgcaaagtagttcaggttgttgaggccatccagcccttgccgttcttttgacttcctcagcagagcatacctgtttagggagggaacagagaagaggtggctctgagtgaggatccatgcctctgcagccagaggatggagcagggcgtcccacagcagaggacgcaacccatggcagcacttctgcagcacaaggtgggcgcacggccaattctgctatgccaggctgagtgctgtggtcagaaacacctcctgtgtttcatgccaggtgcttcacttaattatttcatttaatgctcacgccagcccctgctagcaaatgaggaagccaaggcttaataatgtgaggtaacttgcccaaggtcagagagtggggaagtgggaggtaaagcattaaaaatacaacagatgagaaagttcatactctgtattcagtgccattttactcccatgaaaacagaatttcagcaattagaattggttgtctagagcacagtcttccccacaatttagaaaagacacacacacacacacacacacacacacaaagaaagaaaaggtaacacagcaactgcagccacccagacagaagctcaggacaccattcggaacgggagcctgcggaaagggcgccactgctctgtcacctcagggaccttcatccaagctgtttcttcccaaattccccaaaggctactgtggagaccacaaggctgaagacataggacaagtgatttccttcgaagaatcttactattgaaaatgttcaccaacggtctgatccccacactgttctgcctcagagttagaatacatgcaacagctgtcaaacagctgtcagaacagggcctcggggtggggagtaggagaaggggctgtaatatgctctaagatatccggacatgaaagtataggggatacttctaagagacagagataaattccaccaaccttccaagaaactggacttctcctcgatggtgatgaggaatggacttgtactttcctgtgtcaccctctggccggctcacagaatagcctgcattctgtactctgtccaagaccaagagaacaggcttttagatacaacggtaatagcccaggagtgaccaaagcctacaagacatgttacaagcttaccctggaaatcacacacagcaaaagctctcacccgcttaactgactcattgtgtcatttcttaaaaactgagttaaaactcaattttaactgaattaaagtttttatgtgaacggaaaaaataggctgggctaggtggctcgtgcctgtaatcccagcactttgggaggccgaggtgggcagatcatttgaggtcaggagttcgagaccagcctggccaaaatggtgaaaccccatctctacttaaaaaaaaaaaaaaaaattagccaggcgtggtggtgcaggtctgtaatcccagctactcaggaggctgagacaggagaatcacttgaacccgggaggcaaaggttgcagtgagcaaaattgcaccagcttgggtaacagaaagaaaatctgtctcaaaaaagaaaagaaaagtacggaaagaaatggttacttccagggaataaaatagaatcaaaatggggattaatacttagacacttgtatcatctaattttttttttttaagagacagggtccactgtgttgcccaggctggagtacagtgaggtgatcatggttcagtgcagcctcaatctcccaggctcaattagtcctcccatctcagcctcctgagtagctgggactacaggcgtgtgccaccacaacaggctaattttttttattttttgtagagacaaggtctcactgttgcccagactggtcttgaactcctgggctcaagtgatcctcaagcctaggccttgtgaagaggtgggattacaggtgtgagccacagtgctcagcctatcatttgaatttttattagcaaaatagtccttgtaattaacaacaaacacatacttttcaaaagccaagctacaaaggaaacagataccaggtagtattttgcatttgttccttatgaggttactgtttacttactccataaaaatattactttattccactcacacacaggattgttcacccaagcttgtacagtacaagccttatgtgatggcgcagctaaatctatgtagacatatcactaatattccacccttcagtttggagtggttccaatgaaatgggcatttagtacagagaacactggtgaagtgaaaagttttgttagaacctttagcaggaggggcacttagttataatatgccttaaaaaccctatttgcatccattaaaggacagagcttaaaaaaaaaaagagccttaaaatgactacattcgcttataggaatttttcctaaataggaataacaggcaaaagaattatctactatatcacactctaaatagtggaaaatggaaaagattctaaatatacaccaggaaatagttacataaattacagtacatctatataaccgaattaaatggagccacttaagatcctgtttacagagtatttaatgttgatataaaaacagtaacacctattgagagcttatcacatatcagatatgccagagctctatacacattacatcatttaatcctcacaatcctgagatttgtgattttaaaaactgacacacagagattttaaattactgttcacttgccactttttaaacacaaaataaactcaatgaaatggtaacatgttacttattgttgtgggtaatttatttttatactcatttgtattttataatgaacgtattatttattagaagaaaaaattgctaaattataatttgttgattttcgcatgtcaaaggagaaaaatgaaaatagctgctttgttgggatatacagtttgttttttaagatattaagatatttttaaattaagattaaagatattttctaaaaacttggatgtgtgtggtgtgtgtgtgtgtgtgtgtgtattttttaagacaggtctcactctgtcacccaagctagagtgcagtggcacagctctctgtggcctcgaactcccgggctcaagtgatcctcccacctcggccttccaaagtgctgggattacaggtgtgagccatcacagctggtcaatttcatttttttccttaaccttttaaactgtagctactagaacatgttaaattacacacatggcttgcattatattcctatcggatagtattggtctgcagtctaaggtagcatttctagaagacaccgaaagaacggcagaggtacctgttccagaggtcgtcatcttctccaccccaaccccagaaagcattaggaaagccattgattttccgaaattgttccactgttaagccactcactccgccaaagaactcggtataaggaagcctaggaggagatgtgggacatcaatcatctgtgtgttacagggtaactgttttccctagaaggttctcatttgaggactaaaaacagtgctctctgtgctcctgacctgaaccatatgaatgtatcaaattagcaaaattaatttttgcaaactgatttttaatagctttagtgagatataattgacatacccatacacaattggcccatttagagtatatcattcaatggttttagtttattcactgaattgtgcaaccatgaccacaatctatattaacatgtttcatcactgtcccccgcaaagccttgcacccattagcaatcaccccctgctcctcctatcctccttagccccttataaccatttatctactttctgtcactatagatttgcttattctggacatttcagacacctggaatcatatgatacacaacctttgtgtctggcttctttaacgtaatgttttcgaagttcatccgtgttttggcacgtatcagtatttcattgctttctcctgccaaacagtgctccaattgtatggatacacacattttgtttatccatccatcagttgatgggcatctaggttgcagctaattagatttccttttcacatcgctcaccatcctttcagatttaacctctttaattaagaagaaatgatactcacagatacatatacttatccaatttggttgcaaaatgcctcggcatctgtccacatccataatagttgcgatcactttccggtatgtgatctacatcatgaaaaatcaaacagtcccaatccaagtctttcattgcctcttgaaagccaacgttgaaaagcatggctcgattaaagggttgggtaccaacctaaaagaaacagaactttatctttaaaagaatcttgaaggaaaatctttgctgtctttcctgtgcctaaagacgagtttattagaaccaactggaaaagatcactgggctagtgtaaccaggtccaacaccacaaatcaactcacagtgtggctcagaagtcactggacctctggcatgggcacagtggctcacgcctgtaatcccagcactttggaaaaccaaggtgggcggatcaggagttcgagaccagcctggccaacatggtgaaaccccatccctactgaaaatacaaaaacattagctaggcgtagtggcgcatgcctgtaatcccagctacttgggaggctgaggtaggagaatagcttgaacccgggaggcggaggctgcagtgagccaagatcgcaccattgtactccagtttgggcgacagagcaagactccatctccaaaaaaaagaaaaagaaaaagtcactggacctctggccccaatttctttaaaaatgtaagtgatagcaaacgcaagcttctctctcccaaggctactgaaggcagaaatgcaaccgtgtaccagcatttagaagagtaccccgctccacaaagggaagagacaacactaccatttctactccttaccacttgctcttcagcacatcaaccaatctctaactgttcataaaccaaatctagtacaaagagtggtttttagttttgtcttgttttatttttaagatctaactaagacaacagtcactgagcatgccagggactcaagcctatggacaaagaattcagtggctcatgaagaaaccagttcaaatcagttaacagcctaattagtgttacagctacattgactcccccttgccactatcaaaatacccaacttaggaccggcagatagaccgttagcatttcccagatgcccagccttgctgaacagtggtgctcagcttttttctcactccagtataaggcaagctccagggtgaccacttaacagcaactcagactgtgagactcaaaagtgtgcccatagagagaggtgagcatgcaaaagaccctcagactgacgatcagtgtattcagggaaatctgtcaaccttttgtttatctatggatatagcacctctagttcaaggatcacatacttcaaaatgcctacagaagccaagtcagtaatgtaaacatataaagtaggcccggcaagagaaaaccacagtaggacagtcatgttccatctaaaggcaaataaaatatatgcaggaccaaaaaaaaaaagatttacagactgaatttgccatgcggtcttcttcagtttgtgacctctatatctggttccctaccaatatttttaagattaaaacaaaaccaaaccctcaggcttagagaagtttgcaaatgtcccaggccacttggttgattaacagcagacatgacaagcactgaggtctcttgactccaaggccacatcctctgtgctgtaccttgctgcagctctttatcttaaggggaacttcctgggtctggagcctgcaggcaccaacaaaaccataatacaagaggcctttgttcatgagccaacaaagctctctcctggattcaagtgtgcccagtactgggcaacagacatctcaaaccaggagcacagaattgctctctgctcccccttcaaacctcaggcaactcgatcctaagatttcagttttattggctcttcacaccaacagtggattagcttgcagcaacctaaactgctgtctcagaagagaaaaaagaaaggaaaagaaaggactactcacttgttcaaccacataaaatgcaaactgcaagcgctggcgctggagcatgggaagcaggtgtctgaacaggactgggaggtgctcgtggcggttccggaaggggataaggatcgccacctggagtggattacagcaaaagaagcacagttaggactctcagctttcactccttagcaggacacccctgatgaattgctgaccaacccatgggagttctgggaggctggctatcttgtcctcagctttctctaaacaaagatctatgttggcaagttggcccttggacctagatgaatgtgattcttacatataccatatcttatagtacatagtaggcctataatttattctaggccataactcataggaaaacacacattctacactgtgacaaaaatacatctataaacttacaattaaaacaagcttcacaaaacagtatttccccttacaatgtgcaatgtacaaatgctggttattcaactgtttttatttcccagcgatgggctggatactgatgtgttccagatctgctgcatcagcagcacttaacgaggctggcacagaatacgcattttaatagatacttgttgaaagaatggacttcagctggggtcacagcttaacgaaaactactgatgtcttctgactatggtcaggcagaaaaaaactaaatctcaatgtcaagccaggtaactttgctttttaatccactaatcttgtagtaaccaatggagaacaggaatgaagcactgactctgtagatgacttctgcaaatgggtcattagagaccaccaacgccctcatccccttgctttgttaatattcctggtgggaagaccaaagggtcttgctcggtcatcagaataatgcaaatttctgtatctacaaaaagagtccttgtggaaacccattcctctaaaatgtttctacatttgcatggaatggtaggatgaaaatgacaaaatgtcatggttagctaatcccatggtgattcggaccaaaggcaaaccccaggtgggcttctcagcattttggctgtgacttcacaccctaccttccaccgaggcatgcaatcagaaggcttccagtgacctccgagcttgatggttgggtctttggagaagagttcatgaatgtaatccattccaatttcactcatgtttatgtctattgggccctctgaacagagacggggaaaagggattaagaggtcagaaaatgataggtttccctatgcctggggttttagtctctggagagcgcaatgctttttcagctgaatttgtttttagcaaggatggaagtcccttcctctgctttccatctcaccgtatttcagttcctcactattttcaaggtgaagaggcaaatcaaggaattaagactttagagttctgcttctgtcaggggccaggtagaaatgaaaactttaagtaaaacagtagctgagcttttttttttttttttttttttttttgagacagtctcgctctgttgcccgggctggagtgcagtggtgtgatctcagctcactgcaacctctgcctctgggttcaagcaattctcctgcctcagcctcctgagtagctgcggttacaggcatatgccaccacacccagctaattttgtatttttagtagagatgaggtttcaccttgttggccaggctggtctcgaactcctgacctcaagggatccacccacctgggccacccaaaatgttaggattacagtcgtgggccactgtgcccagccttcttttttttttgttttgtttattaatatgttttaataaatagagacagggtctcactatgttgcccaggttggtcttgaactcctgagctccagtgattctcccaccttggcctcccaaagtgctgggattatagctatgagcccctgcacctggctgcagctgagcttttctgagaagaaggagaaaagcagctgagcttagagtcatgtcaggtttgctcctgatgcaagtgcagccacactacctctctcaatccattcaccagtgggtcaggaccctgagtgattatgtcctaactcagaatgctggtcatctctgacttaagtcaggaagtggtacagtaacaatcaataaatgctactgaaacaatgaactaataacattagttttaggcctgtcaacgcctatttctgatacacaaatctcagccttcccaaactaagcttacatctagatgcagacaaatgcaggttttaaagggaaaacctatatatgtgtggtgagacatgcaaatgaaacagtaaggcttccaacacaacttacatacttataattaattattcatatatggatgagaatatgttcaaataccatgcacgactatttctaacattttccctattttcactatatttgtgcataaaagtcaactttgcaaatgtaagattttccttttcttgatctcacttcttaaaaaaaaacaattttaaaaaaagaagtggggaaccatattaagaagcctaaaagtataggaaaggtataagagtttactgtccttgttttagcttacacgagattcaaaaaaaagaacaaaaagatctaagaattgttttaactagcactttgttaagaaaataacttccaagcaaggcatggtggctcatgcctgtagtcccagcttctcaggaggctgaggcaggacgattgctccctgaagttggagaccagcctgggcaacatagtgagacccccacctctaagatcaagcactacaatcagtgagaggtttatactaaaaagacaaagctgactgcctatacagtgatgtgctttgacattttcaccagtgacggatggcatatacggtggttgcataagatcacaatggagttgaaaaattcctactgcctagtgatgacatagctgccatagcattgttgtgttactcaagtgtttctggtgatgctggtataaacaaatctactgcattgccagtcatataaaagtgtatcacaaggctgggagcagtggctcacacctgtaatcctagcactttgagaggctgaggtgggcggatcacctgaggtcaggagttcaagaccagcctggccaacatggtgaattcccatctctactaaaaatacaaaaattagccaggcgtggtggcagatgcctataatcccagctactcgggaggctgaggcaggagaatcacttgaacctgggaggcagaggttgcagtgagcggagacggcaccactgcactccagcctgggcaacaagagcaaaactccctctcaaaaataaaaaagtatagcacatacaattatgtagagtacattatactagataatgataataaactatgttactggtttatatatttattatactatatttttaaatcattattttacccttttgaaacagggtcttgctttgttgcccaggctggagtgtagtggcacgatcatggcacactgcagcgtgttgcccaggcctaggtgggagggttgtttgaggccaggagttcaagaccagcctgggcaacatagtaacaccccatttcttaaaaaagtaataataataattttaaaattagccaggcattgacaacaggcacttgtagtcctagctcctcaggaggctgaggcaagagggttgcttgagcccaggagttcaaggctgcagttttttttaaaactttttacaagttcacaagtttagaaagtagaaaggtataatagtaaggttcatctaccattaaagacagacaaatattttctgaataaatttggtgcagccaaagtgttcagtgttcataaagtctacagtagtgcagagtcatgtctcaggccttcacgttcacattcactccacgttcactcactcactgactcaccagagcaacttccattcctgcaggctccgttcatggtaagtaccctacacagctgtaccattttttatcttttatatctcattttttactgtaccttttctatgtttagatacacaaatacttaccattgagctacaattactgtatagtaccatgctgcacaggtttgcagcccaggagcaataggccataccatacagcctaggggtgtcgcaggctacaccatctagatttgtggaattttactctaggaggttctcccaacaataaaatcacctaatgatgtacttctcagaaagtaccctcgttgttaagctatgaatgactgtattcatactttctctaggaagttcaaacagaacccaagttacaaaggacaggcaagggcaaagggaagagtgaaaaagtaggaaaggtagaaaatggcacccaagaacacaggcaaccttgcagcaggctttgaagaggagccaggagcacaactttcacaaaccctgtttccaatggcagggaggtatttatattctctctgcaggcagacagagagatcaagagtgccctcccctttatccattttaaaagcagaggaagacaggccagagctgtactcactcatggaagggagtctttcagggcaggtatggtttgcaaagtaggtgaagtcttcaggaagaaatgttgtagtttgcaggaaggtttcactgtggttcaagtcaagaggataatctagggaggtaaaggaaaaaagtcgatcagactggtatgtgtgatcaaccgtgcaattatcagatgcctaccaagtaagtctttctcttagctatcatcttggtagaaggagacaggactctggactaccgctttgatgcagctaaaaatgtgaacccatcaataaaaatgtcagccaaatggcagattttaaccagtgttcctattcctattgattttataggtttatatgcagcactcagtttacagtcaactgtaattaaatgtaattttaaaaacagcagttgccctcctctcatttctgttttctaaaggaaccacttgcccttcttttggccaagtatctcagcatttatatgcagtattcacctctgtcagcctctacggctggtcgtgatgtttctgttttcagtcttacctaccgacctcccacttatccccttccttctgccacccctgccacacgatccccttccattccccagtctcccatcggtcacatatcatagctgtggttaggacaatcttcagtctttgtattacgatgctgctgttaagtactagtcgtcgctgagaaatgtggaaagttatgcatcttgtttttctgtttgctcagttttatatgcaatgattctaattcaacaccacgcctttcaccaagacatttcctcctaagacatacattaggtattctctcaacttcatcctcccagaggaggtgtggcagcttctggccttcttccatgccaaatgtgcttggggggaggtattctctcggtgatgattcctcccttctgtactctgtgctgcctttctggagaatacagaacaggagttggatgtgagacctcccagtcctctgtctcatcttttctatccagttttccgtcttgccatttatctgccctactttccaagagatttcctcaactttactcaaccttcctttaatcatcatctctgctatcatattttttaactttgaagagctcttgtttcctgaatgttcatttcttactatattcttgtttcatgtttgcagtcatttttctcttattggtatctccagtgtcaatatctttgggtcttttctcctggtctgaccagattctccagagaaatccactcgaatctcctgccagaatggtagagtcctgactataaacatcctgaaactaagaaagaagagaaagaggctggggcatatgtaatccccatcttttcaaatactgtggtcatgccaggtatccccaggttgaggagcctctgttttgccatctctggggttattaagtctccagctcttgccaggatggggaaatgggtctgggtatctgactgctttttaacagctttcaatctccctttattttagttgccacctttgctcctacttcccatattgctagttcctgagcttctgggggatcctggggtggttgctggttctcctgttgctgctttgagcagtcagttttcttgggtttgttaagtcttttatcagtggttcttctgctttctacctaccaaggttttttgctgtggtctccttttgtgttctcattctcaagggtttataatttaaaaaccctcacatatgtatgcccctttagagtcacgttagtggatatgaagagtgtgatggcagatgtctttttcctaggggactgtacttgtagagtaggaggagggtcctccaacctcattttctacagatgaataactggaacaacatacacagaactcagaccaggagccctggctaatgcatgacagagctccaactaaactctgaatgagagatccttccagtatactgtattgtttttatttttttcacagaatattaaatccttttggatccatgctgattctatgaaaattaaaacatcctgttcaaattcactttgtaccctagaattctagaatcttcaactaagatatttttgaaaaagcactatgagcaggtttccaagaatcaaatggctaacacattgaatccttttatatatgcacacggctgcctactctgcgctgcctactctgcaagtactctggggcaaaattcaacgagaggcaacttgaaaattttaactgtgtcttaacaagggaaggaacagaatgctttctgtccttttcagtagtagctttcctgaaaaacactaagcctgcatttatagagaatagtagagactaatttatataaagacataaaccaggctgggtggggtggctcatgcctataatcccagcactttgggagactgaggcaagaggattgcctgagcccaggaggccaagaccagcccaggaaacatgctgagaacctgtctctacaaataattttaaaaattagccaggcctggtggtgcgcgcctgtggtcccagctactcgggaggctgaggcaggaggatcacctgagcctgggaggtcgaggttccggtgggcaatgatcacaccactgtactccagcctgggtgacagaatgagatcctatcttaaaaaaaaacaaaaacaaaaacatgaaccaagacagaaccttaaagataatatttacacagaaattctctgagctcagctcatacatgcaaacctggcctgggttgaatcttcttctgaaggtagtaactacttcaaaaatctatgtgaagaacccctcatcctaattattactcaggatgaatctaatagatgaaattattctcctttagaaaaaaattaaaagacctcacaagtaatagaaaatgtgcctgtgtttgtgatacgcccatgtgtggcaagagacgctggctggaaacatgtattggcacagtcaatacattcactagaaggcaatgaaattcccaaaagtattacactaagtatattttcataaacaaatcaacaaaaacgaagataataatcattctggtcaatgactgacccaagccctagagctagaacctaatcaggaaactagaatttaaaaaacatgaggcaagagacaagatatcactaactctaatgattctactatttggagtttctttgaagatagataaattcctttctacttccttcaaacaatgatacagtaagcctggtagcacctagcatgaaacaaaaaaaaagcatttatttttcttctgattactaaattaataatatgtcactgttttaagaatcctcaaatacgcaacaactctattgcaaaaatcttccagaaacttactctacatcttgggaggggtggcttaatttcctgatttcttgtttaaaaatttttaaataaaactttaattaaaataaagtctacttggaaggccaaggtggggtgctcacttgaggtcaggagttcgagatcagcctggccaatatggtgaaaccccatctctgctaaaaaaaaaaaaaaaaaaaaaaacacaaaaattagccgggcatggtggcaggtacttgtaatctcagctactcaggaggctgaggaaggagaatcgcttgaacccaggaggcagaggttacagtgagctgagatcacacggttgcactccagcctgggcaacaacagcaaaactccatcataaacaaacaaacaaacaaagtctgcttttcagtagcaatagaggccttttaaaatgaaagagacagaggaaattaattgctcacgacctggtaaaactatgtgcagttatcgtgaggagcccttgtttttctcccctgctagctgtccagcaacgggtggggttataccttatccccttggagttccaaatataacttcttactcttctaaagcatgtacctactgaatgaggaaaatgctgagagaaaaacaagcctgttgaatttctacagccacagttttactttttaatttaaatctaatctatttcaaacctggacatgttcttgaagggcaaagaaggcagctgcttttacatttagaaaatggaaaaacaagccgggcgcggtgatctctgcattttgggaggccaaggcggatggatcacccaaggtcaggagttccagaccagcctgaccaacatggtgaaactgtgtctcttactaaaaatacaaaaaattagccaggcacggtggcatgcgcctgtagctccggctactcaggaggctgaggcaggagaattgcttgaactcaaaaggtggaggctgcagtgagccgagatcccgccactgcactccagcccgggcaacagagcgagactttgtctcaaaaaagaaaatgggaaaacaggccaggcacagtggctcacatctgtaatcccagcactttgagaggccaaggcaggtggatcacctgagttcaggagtttgagaccagcctggccaacatagtgaaaccctatctctactaaaaatacaaaaattagccaggcatggtggtgggtacctgtaatcccagctactcaggaggctgaggtaggagaatcgcttgaacctgggaggcagaggttgcagcaagccaagatcgtgccactgcactccggcctgggcaacagagcgagactccgtctcaaaaaaaaaaaagaagatagatagatagaaaatgggaaaacaacagactcctacctacaggttcaaatggctactgatatcatgggcttgcagaccaacatttctgtccaacagcaactgcttattcagcattgcttcacaccagtggttcagcagccttggttgcacattggaatcatctaagaagctttcaaaaatcctaacaccaggccgggtgtggtggctcatgcctgtaatcccagcactttgggaggccgaggtgagcagatcacttgaagccaggagtttcagaccagcctgggcaacatgatgaaacctcatctctactaaaaatacaaaaattagccgggggtggtggcacccacctggtgtcccagctactcaggaggttgaggcaggagaatcacttgaatctaggaggcggaggttgcagtgagctgagatggtgccactgcagtccagcctgggtgacagagcaagactgtctcaaaacaaaaacaaacaaacaaaattctaacattcaggctatacctcaggccaattaaataagaatcgctagcagtcaggcacagacatcagtactttggaaacgtccttgggaattccaatgtatagctaagcttggtattgctaccctaatacctggaggaggtaaaaacctgccttctcccttgtgttaccaaatccagttgagaaggaatcgaaagtgctgaccaatggaccccagcaagaatcaccactttcccctcccatttgagaaaagaccaaacacttgcctctctgcttgaaaaaaatatggaaatttatatatactagaaagatgccactgggacaaatatctgtgaaatataaagaattagcattcttcaagagttagtccattaaaggatgactacctactgggagggtagccacatcgaagactacagactggacatctaaaaccaccgagaaagaggtgaagatgacccactccattaatagattacaaagcacaccagcatgactttactcactctgcagattcacaatctcacaaaccaatggctttcagtgacaacaggaagcttctcctggtcaccacttcaggtttatttccaggttcacagaccccatccccaaaagtctgttttcattcactaatcaccatgttgcttttaaacttaaagaaaaccagcatgacttaaatgtcaccctgggcttttgagctatgcttggcctaatgcagatgcctgaatgtgggtatgtgcctcagcattatttcagcagaggatggtgcataatccaggttaccaccattaagccaacagtgctccaggcagaagtggtcgggccagaggtgtcagtcatttggctgtctcagcagtgctgggcccagaataccctctctgactgtgctaggtagacaactgctttgaaatgaagaagaatgatgggttttcattaaatacactttcagtgaaatgctattttcttttcagtacaggttgagtatccccttatctgaaatgcttaggaccagaagtgtttcagatttctgattttttaggattttggaatatctgcattatacttaccagttgatcaaccccaatctaaaaatccgaaatctgcaatgctccattgagtatttttttcaagtgtcgtgttggcactcaaggtttcatcatgtgtggattctggagcagtctggagttggtattttctgattggggatgctcaacctgtacttactcgccaaagatgtgccagtgacacagcagctccacaagatggtgacctccttagaaacatgctacaacacttaagacgtgctttcttgttaaattcattccttcatgcatacaaaaataacttaccaagtgcttcctatgtgcgaggcagtgtataaggtactaaggatacaaagatgacaaaaggaatgaagccattactgcgattcagggcacaggccctggagtcagagaatcagcaaaccctaaccctgctgctgcatcaagttccatgacttccatgtgccttgttccttttatccctacaatggggacacagtagctaccttctgggttcttgtgagggactacatgaaatcatgtaagtcaagtatctaataaacagtaagagagtccctgatggcacagacttccaatctattagagaaataaacacgtttaacaaaaaatagattgttctaaccagagagatgcaaggaaaaggtatttgggtgtatgataatttgagaataaaagtacaccaagttcaataataacgggtcactggatacaccctccaagggtgaaactcacctctgtactcagttttcaaagacagcaactcaggaagtagcgcaatcctgtgttgccagaccggcagtggtgtggaaatggggtcctgctgcatgcccctctaacttctgagagaactgccagtactgccaaatgcccagagagacagatattccagcctcatctaacactgcagaagtatgacatctggactggataaatgtcatgaggacacaaatgttcccttactcagtgctatacaggggagagcgctctggaagggcagtcagtactgcctcgtttcttcacctaactagaagcaggattttggcagggtttagggaaagagtcacatgatcaagctgcgccatcttccccaagattatatgtactatgtgtgaaaaatgcaaacagcataaaattctgccttaactgacagagccacatgagtcgagtgagaatgtgtgtgcggattgtgcaaaacctaccaccacatgcaagacggaaactgcagggtttcctctcccaggtatggttcagagctcaggtaacttgacccagtgcgaccacaatttgtctaaaaagctctgaaatgtcattcacttgttctttgccaacaagaaagtatcaaaagtttatcagtttgctaactacagtcctctgttgctaaagtggacggcaaaggaaactgataaattaggatgtggtcaattcttttaaggagaggcaattcttttaagagaggcaatgttttctcttgattttctaagcgccacagaataattcgcatttgcaacatttgcaaagcaatttcacattcgacagtgaacttccaaaaatcttgtaacttattagagaagaagagaggactgatttagagggagaatttttttttaaatgtaagtattttaaaatattgggcttagacgaaatcattaagaagccataggaggctgggtatggtggctcatgcctataatcttagcacttcgggaggccaaggcaggtggatcgcttaagctcaggagtacaagaccagactgggcaacatggtgaaagccgtgtctacaaaaaatacaaaaattagccatgtctacaaacaatacaaaaaatgagccacggtggctcacacctttaatcctagcactttgggaggacgaggcaggagaatcacttgagcctgggaggtcaaggctgcagtgagccaagatcatgccattgcactccagcctgggagacaaacttagatgccatctcaagagaataaaaaaaaaagctcgggcacagtggttcatgtctgtaatcccaacactttgggaggccgaggcaggcggatcacctgaggtcaggagtttgagaccagcccggccaacatggcgaaaccccgtctctactaaaaatacaaaagttagccaggtatggtggcgcacacctgtaaccccagctactcgggaggctgaggcaggagaatcagttgaacccgggaggtggaggttacagtgagccgagattaacaccactgcactccagcctgggtgacaagagcaaaactccatctcaaaaaaacccaaacaaacccagaaagcacattagtcctcagttacagaaatgaggcgaatcatgaatccttagtaagatgaaatctcagaatctattttttaaataaaaaccatccctggctggactagagaggcctcaagagagtcccacttaatcatgtggaagtattacttccttcctgtattcagtttttgaaagagttgaaaagaaagagccctggcacagtggcttatgcctgtagtcccagcactttgggaggccgaggcaggcagatcacttgaggtcaggagttcaagaccaacatggccaacatggtgaaaccccatctctactaaaaatacaaaaattagccaggcatggtggcatgctcctgtaatcccagctactcaggaggctgaggcacgagtatcacttgaactggggaagtggaggttgcagtgagccgaaatcacccgttgcatgccagcctggatgacaggagcaaaactccgtctcaaaaaaaaaaaaaaaaaagaagtagtcatccagtcactcttaatgtattatgctatagtttaaatgtctgtcccctgcacacctcatgctgaaatgtaatccccaatgatggaggtggggcctacagcaggtgtttggttcacaggggcagatccctcacaaatggcttgctgctgttgcggtaggttctcctctattagctcccacaagagctggttgttaagaagagcctggccctgccctcctctcacctgccacattgcttcctctcaccatacacacaggcttccccttccccttccaccaagagtggaagcagcctgaggccctcaccagaagcagacgctggcatcacacttcttgaatagtttgcagaaccataagccaaataaatcctttttctttgtaaattatccaacctcaagtactcttttatagcaacacaaacagactgagtcatattgttaacaaaaatgaacgaggattcatttggcaagagcttttttagcagtaaagtaaaactcagccaaatccctcttttacaatgcgcttttcccattgaaaataattattgcaaccgaatttacctctcttgggaggagacattctaatcagaccacctctttactaaaaatatacctgagtcatttacactgctgttcctcttggcataagcactccgaagcacctgctcataaacctgagcaccgattgttctcacgttgtcccggatcagaatgccttgggcttgcatcatgaagaggtaggtgttcactgcagaaagcaaaaaggggaaaaagaggtggattcagaagcaatcatttaaaaaaacataccacatagctatggatttttttttctttttggacttttaaagcctcttttagttcttttaaaaccctacatgaccataactctattttccatacctttcaggacaccaacatcttttgggtagctagtagagcttagaggaatttctgtcaatatccaacagttctagaaaaagcatcaacttaaaaaaaaatatattccatctcttctccaaatacccaatctgtattctagcactctgatcatcagaagaaagacctttatgaattagttaaaactttttttttttaaaggtttctgctctctttaagttcaccttctcagaattagttcatggttcttcatagagaaaagaaaccactgactctctgactgctagaagcactgaagccatggtctgaagccacggtctggtcttggcaaccttttcaaagtggtagactgaggctccaatcacttacccttgggagatttggaaagaaaaaggagtaacgaaagactatttgcagtcctcactatccacccatcccagcccaaaagtccaaagcaatagggaaagagcacagtccaaggtcaattaaaacatgctcttaacaaatgagtgttcagattaacctgccaatcttgtcttctttggaaagtgatctccacttgcattttcctgaagtctctctatgatacaaaactagaagctcacaaacacgtcaaaatgtaatccctatattctacttgcaaactccactgctatgccatctattttcaagaaacagtgagattgtaaaacatagtttcttaaccagtcactctaattccctcaaattgcctttgtcattgtgaaagggggatgtgttacaggggtggaacatttacaaatctaaactttgtgggtgtctgggggtggattcatctaaccgcttggctaacctcgggaccaggccccagtgcctcctccacactcaatacatctggccttgggatgtggattccggctctttgacaaaacacttggctgacattaggtttcatcactattaaagcagtatcctgtacataatgcgcagcaaacaatgactgaatggaataatggacgaagcttagaagtcactgtatttcaagctagtgcttttggtgctttatactgggaatgacagaggtggggtgggttagcataatgtcaaaaaccccacgtggccaacattaaacagggacattgaaatctttcgaaagatttcaaatcatctcttaaggtatatcccaagccataaaataataagcaaaaaggaccagtgttcagaatgctttccgaaatgagggagcagtttcaaatgcggccttgcattgattgggagacagccctatgcttaacttctggcaccgtcggagaatagatcagatattgtgtttattctctagtagctaggaaagattttaaggaaaaaagacagcttccaattattaaaaaaaagtataactgtgtgaagtctctgaaagcaggagtaacacctcattctctatttccagcagataggacactgccagtcacagtaggggggcagtccacaaatacttgttaaacctaagacttaaacttcatctaatatcacatttctaattcagtcctgtgttgttgttgttgtttttaatcatttgggctgtgcagtatgttcccactgccctgaaatcttcctttcatcccaacatattactaaaccagttgtcttattgaaaattttgtgtaaagcttttattgtatttattgaaaatcttgtgtaaagcttatagtaaggtgccgccaagaactcactacctcctttcctctgcactgcaaaggacacagttgcttagcccctcctttaaacactctccctttcttagctttgcatcccaactggaggattcctctagggcagtcattctctaatgtttcccacccatcccccagagtgcttttaagaagcctgtttcctaggtcccactacccagactgatgcatctggtctgagtggggcccatgaatgtgcacttgtaacaagctcgcaggtgataaatggtgctggactaaggaccacacttctataaccactgctctagggaactctggccacataataaatataagcaacatttattgagtacttaattacataattccttactgcatttaatcctcataattatcctaagaggcaagtaatactatccaatttacaaacaacttctaggcttcagtttctccaagtatcttcacaaaggtcaactgagagcactagaatttgaaccaggtgtgtctgtgctcttaaccactaagcttttatacctcactcatccatgttctagccacaacctctctctgaaagatttcaagcacccacatggcttaaatgcttactcttaaggagatagctctcacatcttcatctcctgcacaaagctgccagatggatctttcttgacctttcttaattacagatttatccacactgttactgctcaaaagtcttttacgtctcttgcctttatccctgagctgctgctacagcaaggagtctattctttctgccgtgcaaatcccattaatccttcaaaccccagttcacagacctcttgaggaagctttcagtaccgtgtcagtctccccccttctccagtttctgtgatggtctattacagactatcaaaacttggatttgtttccatgttgacttaattcactaacaactgtctcgtgttagtctcgtcattcaactaataaattaacgtaaaccacatagtatttttttttctaattatcgaaaggaactagcacaatgctaaaaaaataaaaactgagggagtaaagattgccaaacaaaaggaaataatcacaaatccacaacttgggattggatggcattttaaggaacactcaccaatatcatcgaatgcttcccactactggggaactatgacctccaagaacacagagtcaacagggaaaatatggccatcagcaaagaaaacctactttggttgggtacaaaatgtttcccagtcacttgttttttctttttttcttttttttttttgagacagagtctcagtcttggctcactgcacctccacctcccgggttcaagtgattctcatacctcagcctcccaagtagctgggactactacaggtgcatgccaccatgcctggctaatttttgtatttttcatagagacggggtttcagcatgttggccaggctggcccagtcacttttgcccactggttctctctcaaccttccccagacaccctctcccactcaggccccttctatgtgtgcccctcccatatcacaacttcacacaacttcacatcttcatcatcacaacttcatcatcacaacctcactccccatccaggctgcgctctctgcatactggcccagttgtctacacttgacaaagagttgtgaccacactaacggagttgtccagatgcaataggatgagcctagaaacacacaaaccaccagcagccctgttccacctgttaccaaagatctgtaaaagcaagcccctttttggagattcacaatgcacaataactcaaggcccagaaattcccagaagagagatgtttagttatttagcctgccatttcccaaaccagaacatcaagtgagtctctgcagaacttactttgggaaattcagttttggatatttctatgaatagactttttaaacgtccattacatggttaggtaatcaatcaatcaatctttgctgaatgttgttggtaaacagcagtcacatcctattactaattcatatcaagcttgctagaagcaaaatccccttaatctttttagagatgctaaattgcccttctcctgtgcaatgctcatgtagttggttatacaaatcaaactgtaggacctttcaggtgtctctattaaaagtcttgttaccggttgggcgcagtggctcacatctgtaatcccagcactttgggagtcggaggcaagaggatcacttgaggccaggagttcaagaccagctgggcaatacagcaaaatcccgtctctacaaaaatagattttaaaaatactagccgagtgtggtagtgtgcgcctgtagtcccagccactcactcagatcaaggctgcagtgaaccatgatcgtgccactgcactccagcctgggcaacagtgagatgctgtttggttaacaacaacaaaaaaagcagtcttgttaataaacttaggccatggctctggcctaaagtaggaagtacatatgcatacacatgttgctttcaatctaaattatctcattcaaaattcacatctctgtgaagtagatatcatcttgagtgtttattttagattaggaagtcaagtcctccagggggtaatttgcccaaggtcatatggttagagaaatcaaaaccagagaggtgaactgagttgctgcatatattttgatgagctttactttgtttttttctttttgttttttggagatagagtctccctctgtcgcccaagctggagtgtagtggcgcgtctcggctcactgcaacctccatttcccaggttcaagcgattcttctgcctcagcctcctgagtagccgggattacaggcacctgccatcatgcccagctaattttttgtattttggtagagatggggtttcaccatgttggccagactggtcttgaactcctgacctcaggtgatctgcctgccttggcctcccaaagtgttgggattacagacgtgagccaccgcacccagctaactttgaaaattctgaaagcagtactttctaataatatggtcctgcgcaacagtggctgaatcacagttaaaaaaaacaattttaagttggtgtgcagtggttaaatcctccagtttcaacgagtctctactgagcacctccttcactgtgtgcttttcaggcaccgtacgagggcactggaggccaagtatgcataaggcaacgctgaatagatgagtaatgtatagacaaaattcaacaaattacaatgcagtgtggtaaatgcgacaacatttaacacaaattcacacttactaataatttgttttacactttcatgagacaatgtaattattatccagcctcatatctaggaggagggatctcttatatataaccataattcagttgagaaaaataagccccattcaggtctacacaattagaaatttccattcagatgccagtgttagcagccttgggccatggcttaactggacagcttccgggggcgaaggactgggtttcctgcccttcagccacctcttggccacacaatggtgcctttcttcctctctgcttctgattctaacaggaaaacctcctcctttctcactgaaccttaatgtgtatccttaatgtttgctgtggttggcttggtaagctaaaagagggttcagaaccagaaaagaaaccattcccttcctgaccactttttacaatctgtatctcacccccaacatatgcaaacatacaacacacacacactcacacccaaacaccaatcaccctcctctgctttggttttctacttaacatacaacatattttaaaatttatcttgtcccccataagaatgtgagctccattagggcaaggctgttgcctacttcctttaatgctgtacccccagtggctagaatggtgtgttgggaacacagaggatgcataataaatatctgaatttaaaaaataataataataagttgagacaatatagagttttctgaacttggctgtgctccaggaggcatggagatggatttcaagcccttctctttattttgcattagccccctcctcctttctgagaggaacccaaaatactgtaagttaaccagtttcactgcactaacctgttcctaagaaaagctcagtcattcctttccaccaattgagcagcactgccaaaaagattagctttccccccaaaatgttctgttactctcattcctcataaagcttttaaaaacatgttccatactataatgcacaagtttattcaaaatcttgtgcaataatatttgtagtagaaaaacactagggaaaaaagcctaaatgaccatccaaaggagactggttgaatacatttttatactcactcccatggatgagtaccatgagaccataaaaaagaatgagaaaacatttgttatagtccaaaactagaaagaactcagaagagattaaatatttgtagcctattccgattttggaatactatacagcaacaggaataaataaactagaactgcatgcacccacgtgaatgaatctctcacactttatgtgacacaaagaagccagacacaaaagaacacatgtggtatgattccatgtagataaaatacaaaaacaggcacagctaatctacaacataaaagtcaggagaatggctaccctggagtgcaggagagttgaaggtggcttctggtcatcttatttcttaacctggatgctggttattcagatatattcattttctaaacattcaccaagctttttgcttacatgtacacattttaatgttatatgtcaacaaaatttaccttccccaaaaataaggtgagcaaaacccatgaattgacttccaagacatattatgctacttaataaagggaaattgatatgcactcacatatttttacaaaaaaaaaaacataggaagagtaaaccagaaactaataaaaatgaaggggtaggactgaggcctgagtacaccttttatattttggacatttacgtattaaaaaaattatctagctgggcatggtggcacacacctatggtcccagctgcttgggaggctgaagtaggaggctggcttgagcccaggagtttaagtccagccagagcaacatagtgagaattcatctcaagaaaaaaaaaaaaaaaatatatacatatatatatatatatatatatatatatatgaaaaatgggcaaaccctaaaactaaatacaaacacaaacaaataattctaataatacattgtactgaaaacacaaccaacggaaaagtactccgatacattctttgagagatatactgtaaggacaaaaagaaccgtaaagaatctggaactctgtttagcaggtctgttgattacagtcatatttgggtcataatcatgacatggaaatcaatggatgctaaaaccctcaggtgaaagggttgttgaagaggatagtcaaaacacatattcaatgcaccaccccacaaattacatgttgatcacaactgacatttgtaattttgctgcataagaggaagatctagcaggtcatccctttaccaaatgtctcaactcagcaaccccaatattagaacaacctacagttccaggctcctaatgcaatgtaagatatttacttcctatataatattcttgctaatctactgaagagaaaacaagaagataaatctagaatatcccttaagagttgggatctcactctgtcacccaggttggagtgcagtggcatgaacatggctcactgaagcctccaactcctgggctcaagtgatcctcccaactcagcctcaggaggagctgggaccacagcggaatgcccccacacacagagctaacatttatatttttttagagatgaggtctccaaatacacacacacacacacacacacacacacacacacacacacacacacacactttagattcttcaggctgaaagaacataggatattctacaaaataactgatctggaccaaaaaaaagcaggggctattctagattagagacataactaaacgcaatacatgaactttgactaaattctgaatagaaaaatcagagtgctaaaatagatatttttgagacaagtgagaaaaattaaacatggaatgtatatcagatattactaaatgttaagcttaagtgtaatcatagtgctgtgattatgcataatgcgcttattctcaggagatgtatattgaagtatttagaggtttcgcatcatgatgtctacaactttactttcaaatgcttctgaaaaaaatgtgtgcatatgcacatatgcatgtatgagcttatgtatgcatataaaaagttaaagcaaatgtgacaaaatgctaccaactggtgaactcaggtgtagagcatatatttattgtactattttctcaatgtctctacagatttgcaatttttttccaaaagaaaaataaaaggttgttaattaatgtgttgcaactgccaggttaagtggcttactgttctgctggacttcaagctttctccaaaaggggaaaagtaaagtggccacttactctccaggagtggccaagttcccaactttatttaatgaagaaacagagctgggcacagtggctcatgcctgtaatcccagcagtttgggaggcctaagcaggaggatcacttgaggctaggagtttgagaacagcctgggctgttcctagtgaggctctgtctctacaaaaaaatttaaaaatcagctgggcatgatggcgtactcccaagctacttgggaggccaaggtagaagaatccttcgagctcaggagtttgagctgcagtgagttatgatcatgtcactgcactccagcctgggtaacacagcaagaccctgtctctcaaaaagggggggtgggggggtagtagtaataataataataataataataataataataataataataatgaagaaacatcaagtcctaaggactttttacacttctataaaacaccagctacaaagagatgatgaattcttttataaatgttacaaactgtaattcagacatacattcattcaacactcattatatacataagatgttccaggactgccctatactctaaagataaagagatacaagtaagacacagtccctgccatcaccttgcaatggaagaatagtcacgtttgttcaggggtacaggagagtggctactagatcatattgggagcaggggccaggaaaatactctcagaagaggtaattctagagtatggtcctgaaagaagagcactgaagcaggagagggagcagcataaatgaaaacaaagagccatccagggggaaatacatctgaggaatcaaagaagtttcatatggctggagcgaaggttgcatatggcaagaacatgagacgggaggctagaaaaatggggggagcaagagcgaaagggcttcacgcactatacttggggtctgaacttgattctgaaagccacgacattgcagaaacggtccaggattggatttccagtgggccaatgagtaggtatcaatcggaacaagtaaatttaccctactcaaaattcctggctccagattaaggactgaactttttagtatccacatctaaattcttagatgaactaaataagattctgtgtgtagaatcccccaggtgattaataaaagttgggagcctgaatcttagcaaagactgtactttctacatggagcaatgcagaggaacaccacatctccatggcatgtagagtggagggaaaatgtcaagatataaagctagacacaactgaccagagccagaaagaatgacactcagcaaaggtgctgcttggtgctcaggggggtctgttagactgggttttctttctctgaatttactcacatcatcatcccactataaaatgtgggatttataacagagtcaaataaattccagaaaaacactggagccaatctatggatcacaggttctacctctttagcatgtccatgcttttggcataaagaacagggaaaagggaagagaatctaaagagaagagaagcagaaaatgaataaatagaacaggaggctccctctcacgctcatgcttgctagtgctctctccttcccccatatacaaaatacacagataagacacaataaaaattaaggaaaaacaaaatgtgccaaaggaatgttgaagtttgatttctgccatgctagagtatctgcaaaacctgcattatctttttagaccaatattttgtggaaaaagcacaacctgaaaaataattcaaccttacccccaaacaagcagatgatcagtgttcactgctctgcacaacaggtaaagaaagaatctgcttattctgcttataaagagatggattcctatacaactaataatgcatttattgagtccttatgtgccagcacctttccaaatgcctgtgttttatctcatttcatcctcacaataactgagaggcaggttgttaccatcaatttagagatgaaaaaaactcaggtctgaatacgcaatctgaccatgtggagccaagatttcacagcaggctttgtctccagagtccagatttttaacaaacatgctctactgcctctcagatgctcaatcccctgaatccacagctactatgctgcccacactttgtttgattccttttacttggatctttttgaagtgtttttttttttttggcttgtgttgttgttgttttttttgagacggactctcgctgtcacccaggctggagtgcagtggcgcgatctcagctcactgcaggctgcgccccccaggggttcacgccattctcctgcctcagcctcccgagtagctgggactacaggtgcctgccacctcgcccggctaattttttttgtatttttagtagagacggggtttcactgtgtcagccaggatggtctcgatctcctgaccttgtgatccacccgccttggcctcccaaagtgctgggattacaggtgtgagccaccgcgcccggcctgttgttgtttttgacaggatcttgctctgtcactcaggctggagtgcagtggcacgatcatggctcactgcagtcttaacctccctggctcaagcagtcctcacactttggcctcccaaagtgctgggattataggtgtgagccaccccgcatggccaatattacctggatctttactgtcaacatgtcatatatttcaggcttccaatattccacttcaggagtgggtgccaatactcacgctataatgcatcccccaaattttataagtttgaagctctaatgtgaatcatgaatttttccattttaaatctgcttaaaatgctggatactcatactatgcattacatacattaacatacatttaagagagaaaatacagcttttttaagatacaaggaatttttggcagcaaaatttacacccattgtcttatctatttaaatattttggagcaaccgtgtgacaattttcatacaaaaagtgtttaaagagaactgggaggaggggggacacatacacacattaacaaagtaaataatacaaaaaaatattttgggggaaaaattgatttgaggaaacttttgctttcctaatccttctcatttgaggcagaaaaatcacaaagtcattcgtaggtttcatttttcaccctaattactattcctagctattaaaaaaatccaagtggtaaaaattaacagctatgaagtaccctataaacatttccactgacctattagtctaccatctgttaaattattaaactgtacataagattagacatgaaaatgctgtctaaacagatactagatggctgggtagcctatggtaagtactttactgatctaagcttcagctttgcttcccccaaaattcttaatagcatgaccagttatcaaccctcagaagtaccaatatccacatgcacagccacataacctcagtataagcttgggtgggagaaaactgtaaattaccttgctggttccattgaaactgaacacgtacacttatcaaaacaaccctgcggagaatgggtgggggtggggggggcgtcagggtatgacggatgttgctgatgggaatgtgctagaggcacaagaccagcactgccacactcctctgtggaactgaaaccagaacaaaggctctgctcccctcacctccgcaccccctcgtcctaatctctgtccgtcaccgcccccactccaccgaccaatccctgtccctgaattgccttgtggttccagcctcccacccccactgacacctcctctgtatgaacgtgcttttgtgacacccgctcatactaagctttttttttagacagtgtctcgtcctgtcacccaggctggattgcagtggcacaaacacagctcactgcaacctcaacttccttggctcaagcaatcctcctgcctcagcctcctgtgtagctgggaccacaggcgtacaccaccacatctggtgaatttttttatttttgtagaggtagaatctcactttgttgcccaggctggtctcaaactcctgggctcaagcaatcctcctgcctcagcctcccaaactgctgggattacatgtgagagccatcatgcccagccaatactaagctttaatgtccctttcctagcttttcctggtatcatcccacccccaagattagaactgcctacacctatctttgggctctttctcaactgatacaccaacttctatccatgacctctacaaatttgagcatgtctctctcttccaatagactgtaagctccttaagagtacagacagtcttattcttttcttcatcaacttctgataaatagtaggcatttagctatttattaaagaattacataggctgggcgtggttgctcacacctgtaatcccagcactttgggaggctgaggcaggtggatcacctgaggtcaggagttcgcaaccaacctgaccaacatggagaaacaccgtctctactaaaaatacaaaatcagccgagcatggtggtgcatgcctgtaatcccagttactcgggaggctgagaaaggagaatcacttgaacctgggaggcggatgttgcagtgagctaagatcgcgccattgcactccagcctgggcaacaagagcgaaactccacctcaaaaaaaaaaaaaaaaagaattatagcttggcacacagatgctgtgatagccggaggagttgccttgcttttttaaggtagaagtatactggtttttctgcaaccacaaaaaaaaaggctataagccagaaaaggtcatagtgaaactgatacttcaccaactgtgctggtgttcgtgcagactggtataaaccctttgggaaaactatttgcaaattcaacaatagccataaaaatgctcataccttctgagctagcaaagtatcctaaatatgaggctattctatgcacaaagtttttacttacattatttctaaaagcaaaatcttgggaaacaactcaaaatcaacaaccagcagctctcagtgctgctctgcctgtggagtagccagtttcttttcttctctaataaacttgctttcacttactaaaacaacagcacataaactgtgacacaaaacttgacggaatcttacacatctttaaaagtgaaaactatgcaaccttatcaccatacaccttatgtataatatttagcatagactatcacatttttaacaacatgaaaaaagttctgctatatcttgacaactattgctaaggaataagaacatgtatcaggctaaaacagacttgaggcaaatttaccaacctgctttgctgttagggagtaacagtgatgtgagatgaccttttttccttctgttttaccaatgttctttacaacagtaatgatttatttttttgagacagggtcttactatgttgcccaggctggtctcaaattcctgagctcaagagatcttcatgccttagctcccaagcagctgggactacaggcatgcatcatggtgtctgactgagtgagggtttaaaagaatgcaattctatagcaaaaagttgaatttcttcaacactgaactgctatctgcctacaactaagtttcttctaaccctttgcaaacatgtaacgtaaaattttaagttgacactacaaactgcttgtctaaatgagtcaaaagactgatacctgttctaccaaagcctcaccaacattcagaggctttggtggaacaggtatcccacaccttgttgatggaaacaaattgatataacctctagagaggttggcaatacagatcaaagtgaaatgttcatactctaacccagtagttcctactttcaggtattcatcctaaagaaataattggataaataacaaatgtgttcaatactgtttatctcagtgctacttataaaagcaaaactccaacctatctatgcaccaaaagggtctggaaaaaaaattatggcaaaatcagaccatgactaactcagctatcactgaaataatgattattgttttagaagtactcactatttaaaaatcataccgtgcaggccaggcacggtggctcatgcctataatcccagcactttgggaggccaaggtgggcggatcacctgaggtcaggagttcaagatcagcctggtcaacatggcgaaaccccatctctacaaaaaatacaaaaattaaccgggtgtggtggtgcatgcctgtaaccccagctactcaggaggctgaggtggatcacttgaacttgggaagcagaggttgtggtgagttgaaatcatgccactacactccagcctgagtgacagagtgagactctgtctcaaaaaataataattttctgagattatgtctgcatttgtgctaaataatttacgctaggagcagtaataaaagcagagatgaagctattgattcaagacggtatatacattgtatatatactacatacagtatatcacatttgtgttaaagacacaaaggaaaatataagcctagaacagttttagaaatcacttatcaagatgttcagtgttttttatctctgtgtggcagaattacaggtcatctgggttgtcttttctttgttacaatgcaacatttccatgaacatcagaaccctgtaagataaggaggttctctgttccactagtgaaaaactgcagtaaccaaatctgtttaaatcaactgacccaaaatttcaaagtttccaaagttactgagaaccccttttcacacagcatctactttatgagcaccctttaggaatgctgcctttgggcagggtctttttcttttcatttttttttaaaacaataatcaataaatttttgtatggggtcgggggaagcacaaaaacacaaccttctgccttagtaagagattcctcccctcttcattgctccagaccctaataattcccctaatctcaaactgttattctacccccaaattatcctaccccaaatgattcataatgatcctaaagctcttggtgcttctagctttaacttcatcaagcaagtttcctctatctagcctaccatccaaacatattcttccacatactgttctttggtctccctcctgattctcttttggaaagattattcttcatgtcctatggggataatatattttaatcacattattgttagcctggaagcttgtaacagactaatgggttatctactcgttgggaatttaagtgcttccaagaaggcagcattccaactggtattaacacccaaactgtcaaacataggaaatcagagccatgctttccataaaaaggcaaaagatgccagagaaagcacttgaaaatttctagcttctaaggcacacacacttagcaaaacaaagtctttccttaacaccttgtgggtaatgaaacccttcctctcctccagatggcttgtcttttgcatatatcaacttgtagtcctagaaacgggttctctgggccatgcagaatgctggattatttttctgtcatctattatgacagacagactctgtcacttgatcagacataaacttttctttctttagctaagtaatgttcacattttaaagcaattcaagacccaagtccacagaaacagaagggccaacctactctacaaaggcacgttggaagagcatgattgatggaaacttgtaaggagtcaggcaaggtggctcacacctataatccaagccctttgagaagccaaggtgggtggcttggcctcgacctccgcaaaggcttggatttaaaaaagaaaacaaaccagaaaaaaaacaaacaaaaaacaaatcttgtaaggctacactttggaaagaaaatcaaaaacaaattcttcccacagatcacataactgcaaagggggaaacgtgcatttacaatggagagatcagataggtaccacttaaccaagtgcccaaactgggttatcaccaactagaacaaactaagattaccttctgagtattcttgccaaaaacttttaatttaaatcgaatcaagctcttagacttatcttctggtttacaaaaatacagtggattggccaggcgcagtggctcacacctgtaatcccagcactttgggaagccgaggcaggcggatcacaaggtcaggagttcgagaccagcctggccaacatggtgaaaccccatctctactaaaaatacaaaaattagctgggcgtggtggtggatgcctgtaatcccagctactcaggaggctgagacaggagaatcgcttgaacccaggaggcagagattgcagcaagccgagatcgtgccactgcaccccagcctgggtgacaaagagagactccaactcaaaaaaaaaacaaccagaaaactagggaacacatcaaagtgacactaggcaattccagaatgtaggacatgcaataatactggcctgaactctttctcaaagagttactacaatgagcagtggatggggtgagaaagctactaaagactaacagacataaccaaatgtaatatgttattttggggatgggggcagctacaaataacattctgagcaccactggatgaggactggatattagaaagtattatgatcacttctcggccttctggctaagatcaagtattgaaaagattatgaaagtactgttaattttcttagatgcaataatagtactttgattaaacaggagaatgtcattttttaaagagatgtgtgctgaagtatttaaaggttaactgcctggataattatcaacaatttaacgtggctcagtggagaaagcagagccacagttcaaacaaaaaaagcaaaatagtggtaactgttgactccagatggaagataatgcttttattgtgttattcttgcaacttttctgtaagtttgaattttttcataataaaaagttctgggggccaggcatggtggttcacgcctgtaatcccaccactttgggaggccgaggtgggcggatcacgaggtcaggagatttagaccatcctggctaacacagtgaaatcccatctctattaaaaatacaaaaaaaaaaaaaaaaaaaaaaaaattagccaggtgtggtggcaggtgcctgtagtcccagctactcgggaggctgaggcagagcttgcagtgagccgagactgtgtcactgcactccagcctgggcgacagagcaagactccatctcaaaaaaaaaaaaaaaaaagatgtgggaaaagtttggtttgggatgtatctagattgccaactaaacctaaatcaaagtatactaatattaaaaatcctgtaaatgggccaggaattgttacagagggaataaagaccctagcaatgttcacataagaagttaaagcactgcggggtttttctatgcccgtaaagtattctttagtctttggaatcaagaactgcatttagggtcgggtgtggtggctcatgcctgtaatcccaacactttggaattacaaaatcccaggaattagtaactttttttagtgagtctgcaaatgttactgaataagccagccgcaggactgctcatggaaggggaagggaggcacaggagaccgaggtgggaggatcacttgagcccagtagttacagagaccagaccagcctgggaaacatagcgagaccccatccctattaaaaaaaaaaaagaagaagaagaagaaaaagaattgcatttagtctttacctataacgtcctataatgtcataggtgaactaaaagaaatgataaatatatcctcctgttgtctctcaatggctttccaccactttcaaggtccaaattcctcatgcttagtatgactcagaaaagtccataaaacctggctcctgcctctggaatttcagttcttgccactcccaactctacccacaatggacagttctctggaacctgctaagatctcagacaatgctgctcctactggctaggtgcaaagacacaaaaactaagatttcaaaagcaaaaaatcccgggaaaaataatctatcacaacaaaagcatgagctcaggaagaaaagggagtggaggggataagagcaggggagggggaccaaacccaactttgcctcccttccccttccacgagcagcctggtggctggcttgttccgtgtgttcagtaacatttgcaaggaccaaaaaaatcactaattcctaagattgctgttactctcaaacaaaagtcaattcccaagcccacacaccccacagtcaagctgagagttaaaactcagaaaactcaaaggccttaggatactgaccctatgctggcaaccacatagctcagaaatgcaacaaatattaaattatggtgtcctgtaatggatttacactttacttttaaatattaacaagacggccacagggagtaagtttatcaagggataagaatcctaacagtacctcctagttcactcagaggccaattaacatttcccaccacgcccaacaacaaggctcctgggggtgttcaaagttgcttatgaccctgtggagctatcagcaggtacctctgccccagaacctattatgagcaatgcactaggggctcggtgcacaaggaaacacctgaactacaactacccaagcaaatatcatatctttgtaggttgtcgggtttcttcagctgtctgaagatacaaaacctcatgtgactgtttgatttttagtctcttctcaccttggtcttcctttctcacagttatttttaaaatcagcaactggctaatatttgaaaactgtcagtagccaactgtccgtttcacaattagatcactgttcaaaaggagcagaattttcaactctagactttagttcaacaagctagcaaatcattacaggaatgagtgacttcatctttacagctgggtcgctgcactatgaggctacactaaaatatacctaattgttgaattccaacatgtctgtaggccctccccgcatcttcaaggttagagtttttattattgcatcctcccccaacccaacccccccagacaaagcttggcattttcggaatccctactcataaagtgactcagtccaccgatgggccaactgacaaatccttaagggattaagatattaccaggtaaaaagtgacttttaaaaatgtacataatacatatatatgtagagagagagagtgtgtgtgtgtgtgttacaggaaagctattaactatactatgaataaaacaaaatttcactgaaaataaaagtgatcaggtagcactgactacaaccttctaaattccccctaaatgaatccacagaaagactttcttgaagggtcttttgctaatttgcggttagaacacaacacactcaagaaaatgatgctcacagcaggacactaatactaagtaatttctgagattatgtctgcatttgtgctaaataatttatgctaggagcagaaataaaagcagagatgaagttaagctattgattgaagactgtgctaaccccattaaaaataaagagaggtatgaatgtgtgccttcacaactcagctcaggatatacttgccaactgagctcttccttccgtaagaaggcccattgctcttggctactgcgcaggggctatgaaggccccatggttctaggactagagcagatgcgtacaaactccctaaagtcacaggaaggaaggggaggcacaactggagagaagttggtgaactgcctctctggcccataggggcatgagggcggggggcacagaataaaaccataaagcaataattttcactatttaaaagaacaagtctaaatggcacacatcctctgtgtctaagatgactagcactgctgttttttgatgagtcatcaagggcagtcatgctgaaaagcagggatacttctgtattccacctatgtaatcattccaaaattatgggattggaacattacaatacctatgatgtatgtccttatatttgtatgtgtttgtgtgcttacccttaagtggtgttttttgttttgttttgtttttgctgacttctttgttctagggggtatttctgcagccttctcagaaaaacctcagggtattagagaaggtacaacttgctaatggcatctggtgagcatgggctggaaggggaaccaccgggaaacacagttgtcaataaccacacccgctatggtgcaaacatgacccacatacaaactgaagtacaagtacaacccctcccaaaagtctagccctaagataatagcacagaaactaagcctaacaaggtgcttggaacctcttcctacctgcaccaaccaccctctgcacaccatccccagcaagaccccctgcctccaactcccctaaagcagcatttccaggatagcactattctttaatccactgacaactttggcactggctaaggcttactatttttatcccctttcacaccattctctgagcagaaatgctaggtgcaaacatttgttggtaattatgttaaagtaagtcttcttaagaacaaatggtaaaatgaatacatgaaaactttgcaatctatttttgaagaattgtctgcaaaaagagtggaaattgagtttttcttacgcagctgaaaggataaaacaaaaattacatataatcagaacacaatataaaataaggatcgtactcccccaaaattacatctgtatttggctgtgagaggtgaaatatctttgattgattgattgattgattgatttttgggatggagtctcactctaacgccctggctggagtgcaatggtgcaatctcggctcactgccatctccgcctcccaagttgaagcaattctcctgcctcagcctcctgagtagctgggattacaggcatgtgccaccatgcccagctaatttttgtattttttagtagagacaggagtttcaccatgttggtcaggctggtctcgaacccctgacctcaggtgatctgcccgcctcagcctccccaagtgctggaattataggcgtgagtcatcacgcccagcctgaaatatcttttaaatcttgttagcatgtgctctgaaagatatgttccaccttaggacaaacagcaaacaaactttatttcttcagaacacagcaaatggcagggtagagaatcaaatgacactggaagtggggccttgatctcacccctcctgatatggcaagcacacagggcctagagtcctgggctaaactaaaagatgaaggtcaacttggttactaatttcgcagagcaagtccaaggcaatcaaaatagaaaagcaaaaccaaccctggaactcacaaaggactggacacatgtcatggaattatttatagtctaggacaggtgaacaataatttggctggacaagaatgcaggcccttttctgagttcactctcactgttccaagaatgaagatgtcttgctattctagctgcaagacaggcaccagccatgagtccctacgtggtggtgtgcatgctgcctctgaaggacaagcctcataattatctggccaagatatcttgaaagaagcctactaatgcataaaatacataatcactgagccctggaagccatccaggtaccctcgggcctttgggagttggacagacatgtagcaaggacacattctctcaaacttcctcctaacacaagccttaatcaatattaagggttaaaaggtttcatttaacttcgataaagtaggtattagtactctcatagaaaaacaagctgagactcaatcactgctttcatttggcttaacagctcactactaggcttgctactaagaccttgaagatccttggcttccatatccacttcaatataaacattgttagtgctgttactggtaatgggggctggggggaatccccagggttcctggagcacaaagcaaagttccctccattctcctaattacattaatttaatcccttgcccactacatgattacattaaaaggggctgggggtggggagggtaacataaagccaagacccaaagttaaccacaatacaaaaggagagaagaatggatactatgatcttccttttaaactttcattatagctgactgcagaactgctgggatgactcaatagattatgggaaatggcctaaaagtctactggaaaccagactgaactgtggccacatcttaaaaataacctcttgcctctaattttcttctcccccaatttttttgactaaaaagggttttttgctgtttcgttgttgttgtttcgcaatcaccagtcctaaaatgaagctaaaaatttattttcattttatccttggtcattctctagcaccacaatcaagaacattaatgagtctttcctacaataccgaaagttagttaaacaaataccttgtttcccagcactttgggaggccgagacaggcggatcatgaggtcagaagttcgagaccagcctggctaacagggtgaaaccccgtctctactaaaaaaaaaaaaatacaaaaaattagccaggcgtggtggcatgcacctgtagtcccagctactcaggaggctgaggcaggagaatcacttgaacccaggaggcggaggttgcagtgagccgagatcccaccactgcactccaacctgggcaacaaagtgagactacatcttcaaaaaaaacaaaaacaaaaaacaaaaaccttgtttcacacatcagctgaactttcagtggacctgactactgaaccccaaaggacagccaggttttcctttaacacatattgctgccataaaaactgctgttatcaggcaaagaatgaataggttatttaggaaatatggcaaatatttaataactgatttttttcagtatacctgccttgaagcaacagggaaatattacaggacttggcccctaagctcagcaatttgtcaaatgagtaagtggtaaaatcacgctctccaagatacctctcactaaatacatttatcacattccagaagaagaaaactattttgacttgattgctacctttaaactgtccctttttcaggttttctatctatttcaaatgagacaagcttatcctttgattaaaatgccatataataaaatccatcaaatcatattagccagagggtcaacaatccagctattcaatagcattatcattattttactagtagcacaaataagagggctgcatgggctgaagagccatttcaacaagctcttggagtgttctggacacagagaccatgagtgttttggaacataaggctgagctatggagacccttctgcagcaaagaattcctgtcagaaataagactcgatattagaggttgttttaaaaaataataataataaaagcactgatgtgcatcctaggatgtttagcaaaattaaaacttaaaaaatttaaacttaaaaagcagtgaaacatgctgtaacatagatgaaccttgaaaacatgctaagtgaactatgccagaacacaaaagtacaaatattatatgattccatttatctgaggtacccagaataggtaaattcacagacacggaaagtagaatggtgattattagaagttgcggagaaggggactaataataggtggactaataatagaggttgagaaggggactaatttttaataggtgcagagtttctgtttggaatgaagaaatcaagttctggaaacgaatagtagtaatggttgcgtaatattgagaatgtacttaacgccactaaattgtatacttcaaatgatttaaatggtacttttttttttccgtaaagtgaaagcaagtttattaagaaagtaaagaaataaaagaatggctactccataggcaggacaacctaaaatggcctattttatgttatgtatattttaccatatattttaccacaatttaaaaaaactgtacataaaaactagaattataatttaataagttccagcactttggggaggctgacgtgggagaactacctgaggccaggagtttgagaccagcctgggaaacagagttaaaccttatttctaccaaaaacaattagccaggcgtggtggcatgcatctgttgtcccagctactcaggaggctgaggctggaggtttgtttgagcccatgtgttttaggttatagtgagctatgatcacaccactggactccagcctgcgcaacagagcaagaccccatctctaaaaaaaaaaaaaaaaaaaaaaatagtaagaagaacataggtggtaaataataaacttagccggaaggacactgaggttctgtatttaaaattcacgttaagagtcagagcgctacatgcatccgtaatcagaatcaaagaatccacactcccaaagtgacaaaacagccccaaactaatttctctcattttaatgctgcagatccccaaggcccagaccctggacttctcgatctacactcactcccttggtgatctcatccagtctcatgatttcaaataccacctgtttgctggacactcccaaatccttatattgagccctgacttctgcactgagcaccaggattgtagaccaacagcctccctgccatctccactcagaagcctaacagttacctcaaatttgtccaaaaccagatcactgtccttcccgtccacaaacctgttctaccgcagtcttcccatcctggttaatggtaactctacccttttaccctcattccttgtcagttcattctcaattaggcaaccagtggcattccttacaacagcagtcaaattttctaattcctctatttgaaaacctccaagaaaggctgggcgtggtggctcacgcctgtaatcccagcactttggaaggctgaggtgggtgaagggcttgagctcaagagtttaagaccagtttgggcaacctggcaagaccccgtctctacaaaaaatacaaaaattagtccggcatggtggcttgcgcctgtagtcccaggtccttgggaggctaaagtgggaggagcatttgagcctttgaggttgaggttgtagtgagcttccattgcatcactgcactccagcctggacaaaggagccagaccctgtctcaaaaataaataaataaataaaaaccctccaatgaattctcatctcattcagagtacacatcaaactctggacaatggcttacactaaaccaggagtcagaagctgtggtgggtgaatcctgcccagtgcctgccagtgtgaataaagcactgctggacaccctgtgcccctctgtgcactgcctactactgcttcggcattgcaggcagagttgagttgttgctatggactgcagagtcgaaaacgtttacatctggcccttcgcagagcaagtctgtctacaccagctcttaaatgatttcccttatccctctgacctcatctctctagttctgcacctcactcactctgttccagccacacgggccttctcgctgtcctgtcctgaagatacccatgcaagctctcaccacaggccactgacccaaccactgtcttggcagcgctgcccagacaaccacatggcttgctcgcacacctcctgaatacctcacttcagtgagaccttccctcatcacaatatatttaaaattgcaaaatttcctctctctactccctgcaaagcatccactttcctctgcttctccaaagcactaattacctaaaaggacacacaagtttgcctaccacatagcagcagcccaataaatatttgttaaatgtagttaagagtattattagtgagcctaaggcaaaaattcaagattccaattctaggccggcgcagtggctcacatctgcaatcctaacacttcaggaggttaaggcaggaggatcacttgagcccaggagtttaagatcagcctgggcaacataggaaggccccttctctactgacataaaaaaatattagcccggcatggtggtgtgcacctgtagtcccagccagttgggaggctgaggtgggaagtctgcttgagcccaggagttcaaggctgcagtgaactgtgattgcaccactgcactccagcctggttaacagagtgggagaccctgtttctggggaggaaaaaaaaaaagtgacatagaaggacgacatatgcttatatacaacaaatacaaattctcaactaaaagttaaataataaaagttatcctagaaataaactgttttgatttcacaaataatgttctccttagaagttgcaaactatctgcacataaatgtgctctgtttagtctaacaggtattttctggttttccttttatctttaagctgaataaattgtcaggtaaatggtttaatggttgaaagtattaactctggaggagggctagacaggtttaaatttttttttttttttttttttttttggagatggagtctcactctgttgcccaggctggagtgcaatggtgcaatctcggctcactacaacctccgcctcctgggttcaagcgattctcatgtctcagcctcctgagtagctgagattacaggcacccaccatcatgcccggctaatttttgtatttttgtagagatgtcggttcaccatgttggccagcgtggtcttgaactcctgacctcagatgatctgccaacctcagatgatttgcccacctcggcctcccgaatgctgggattacaggcatgagccactgcgcccggcctagacaggtttaaattctagtcagctgaatgacctttggcaaattattcattctgtgtttcctcatccataaaacggggataataatatccctatctcatttgtattgaatgagttaatattggtaaaacatttaagaataaagactgcagccaggcacggtggctcacgcctgtaatcccagcactttgggaggccgaggtgggtggatcacttgaggtcagaagtttgagaccagcctggccaacatagtaaaaccctgtctctactaaaaatacaaaaattagccaggtgtggtggcacatgcttgtaatctcagctacttggaaggctgaggagggaggatcgcttgaacccaggaggtggaggctgcagtgagctgagatcacaccgctgctttccagcctgggcaacagagcaagattccatctcaaaaaaaaaagagcaaagtaatagtacctacctcactgggtcaggaagagaagcaacacatgcagagctctaagggagtcttgtatatggtgagcgctaatgtgttcattcagaatttactttaatttaaaaaaaaagttggctgggcgcggtggctcatgcctctaatcccagcactttgggaggctgaggcaggcggatcacaaggtcaggagatcgagaccatcctggctaacacagtgaaacccggtctctactaaagacacaaaaaaattagctgagcgtggcagtgtgcgcctgtagtcccagctgctggggaggctgagacagcagaatggtgtgaacccaggaggcagagcttgcagtgagccaaggttgcgccactgcactccagcctgggcgatagagcaagactcctcaagaagaaaaaaaagttggtccctgaactgaaagaggccacatatcaaggacataagcacgcaaaatcagcaagtgccatacagtaagtactgatctacaacagaaagaaatcaaggcatacctgcagacttaaacgacatactgaagagccacgtccttgttcaaataattccattccaattccccagagaacagaggtggcatgcggtaggattagagtttcactcagctaagacagaggtttgagtccctgctcggcttagctgtgtgatcttgagctcgtgaccaaacttcttacagtcttaggagagttagaaataacaaatgtagattccagagtgattgaaacagagtaggccttcaggaagtcacagttattatttgtataagcctttcagtttagagtaattttagaattatagaaaagttgtgaatatagtacacagagtttccatgctgttattttattttcaacaatattgttattctgattgtgaagagaggtaaacaatttctaaattacaccttaaaaatccatgacaacaaagaatactgtcactctaggaaacttctgatttatgcacttaaacacaccactccgcatcaggtgaactgatttcccaagtttgttaagatgtgttacacagtttaaaggcagacatgactaagaggctaacatgtgtatcacagacctaggaacactttctccatgttgccgtctctaaaaggaacttcagcaggtgcagtgggtgcctcctctcaactcataccacaaacccaggggcttcaaaaattactttccctctaccagggcccttcaaaacacagtatttcctaaccaacagaaaacgaaaaactctgtgacccagacagcccagcctttgaaagcagcaggggtagcaactgctgagcctcaaaagtcagcctctgagtagccacccagaatgcaatgggctggcaaacagtaggggagaaaaacgctggatccaagcctggatcccagtgctcaccggacaatcatttgtcccatttcctcaattatctgtttgtctcctatagctgtctatcataaaggcaatgtgaaaatattattttaaattttacagaatagaaattacggactcagaagaggcatatccagacaataggtagaaaagtagaaaaataacagctattgtcctagaaatcaaatacaatacacactaacatttagatctgcttttaagagctttcaaaaacctcacgttattagacatttttggatagttttaaaagtcttgttctttaacagtaagaaaaatgcatcccctgaattgaagctttagagtatttaaagtgaaaagcttgctaagagataaatgtgcaaaaaaaaaaaaaaagtagtatttgagcattgcagagggatttctcctttctcctgagctgctgctgtaacatctcctctgactcagcacctaagaggcatgatgggaagggagtactataaaaaagccatgcattattaacaagacatttggcatcaaagcagaatgatttggaaaaccggaaaatgtccgcagaataagagaaaggggagctaacagcttaaattatttttggtagtgtcatgccattcaaaattgtccattctaatcttctaagctgtctttttctcccttagttttagctctaattctgatctctttatgtctttcctaccttacattccaaatggttactacttacattctgagtggatttctctgtgttggtttgctcctgtcagttttaaagaactgctgtacacgcattagatccaatgaagacagactgcaacagaactgctctgcagaagcccaagagataccacacataggatgttaacacttactactgcctagaaatcaagagtctgtcttcttaaccctagaataagcaaccaagtgacctaagttcccaattcacagatggcaagccaatggttaaaaaaaaaatacatttactcttacaaccatttttaggaccctagaatttaccatcaaattgtcagtaaaaaatgaagctgggccaggtggagtggctcatgcctgtaacctcagcactttgggagaccgaggcaagaggacctcttgaggccaagggttcttgctatgttgcataggcaacatagcaagaccttgtctctgcccaaaaaaaaaaaaaaaaaaaaaaaagccaagtgtggtggtgcacacctacagccccagagacccacaaggctgaggtggaaggatcccttcagcccagaagttcgaggctgcaatgagctataattatgcctctatactccagcctgggtgacacagcgagaccccatctttaccaaagaaaaaaaaaagaatgaagctggcatatagtccaatggtcagagacaatgacttgagtaactcaaaatccaattctgcttttctggcattatatcaaattaggaaaactattcccttcctttaggccagtagttctcaattaggggtgcttttgcttcccaggggacatttggcagtatctgggggcatttttcgttgtcaccactgcgggagaaaggtgctactggcatctcttgggtaaaggccacagaggctgcaaaacatcctacaaggcacaggacagcctcaacaacaaagcagcatgtcaacagtgccaaggttgagaaactctgccttagacaaatcacttaacttctactgacttttaaattaaccactgacactgttagaaagtacagcagtaatgcataaacgttaagtttatatttgctggttcacatttattggattaataaacatgctgggcgcggtggctcatgcctgtaatcccagcactttgagaggctgaggtgggcggatcataaggtcagtagttcgagaccagcctggccaacatggtgaaaccctgtctctactaaaaatacaaaaattagccgggtgtggtggcaggcgcgtgtaatcccagctactcgggaggctgaggcaggagaattgcttgaactcgggaggcggaggttgcagtgagccaagattgcaccactgcactccagcctgggtaacagagcaagactctgtcctgggaaaaaataaaaaataaaataaaataaacagataatttattttcgattccctataaactgaatatttcttccttagtaaatggagcacagactagcatcaccttttctgcaacataagtaacaatgcacatgtgcaagatttgcataaagtagcctctgcttctggctatgactgagagcctgtggcagaccagagatccctcagagaaacaactccaacagccagagaaaattaaaaaaaaaaaaattttttttttcaaagtctgaagactttggagaactgtggaagctactatgacttgaagagacacaatccggaagggtaaaccctttaggagcaagccaatatgccacaactgctttgcccctcagggaatctgccaatgctaggtgccaggaaggaggctgaggaaacagaaaagcagcctgggaacatgaccagagccactattcacaggcagagaaaccagcagagctcatggtaatgtctcaggcctgaagaaagaaaaatagagacaagggcctaggattcctgtgaaaagaactgagtgttttaccctgaagacattttacaaaatcccaaagatgcacaggtcagaaggctgaaaccaagcagaaagcctctgaatagcacagcaggtttcttcaccaatcccatgtactaagaagacaaagattaaagttcaggacacaccgtgggggacaaagattaaagttcaggacacaccatgggggaagggccccagttcttagccagaactcctgcagggtacttccaaagagtagaggcaaaccaaaaagagatggagcctgaccaaaaccacgcccttgctgtggtcagctcagacaagataaatggaatcagcccccattctatttgcctagcaaatggtgtaagccatctagatattagaaaatcatctagggtcgctacaatttttttatatacaatgcccacttttcaataaaaattaacaggcatgccaaaagataggacaaaatgagtgtcaaggccgggtgcagtggctcacgcctgtaatcccaacactttgggaggccaagccaggcagatcacctaaggtcaggagttcgagaccagcctgaccaacgtggagaaaccccatctctactaaaattacaaaattgccaggcttggtggcgcgtgcctgtaatcccagctactcaggaggctgaggcaggagaattgcttaagtccgggaggcagaggtggcagtgagccgagatcgtgccattccacttcagcctgggtaacaagagtgaaactccatctcaaaaaaaaaaaaaaaaaacagggtgtaatattttaatattgggtaagacagagcaaaaaaagagaatgattgatccaaaagctatgccatcagaaaacatctagactgaaagctggaggagaaggaaggagaatagaaaaatacagatttgtattgagtgctagcctgagaaaatgtctcagcaaaacagtgtttaggtatccattggatgatacatgcagaaataaacacagatgtcacctctttgacaattatacaggatttatgttacttgatttccaagtaacaaagacagcaaaataatcagaaaaaaaatatttagactcaatgagaaagataagagagatccttaacatactgaggatgaagaacctgataattcttagctcactctcttatcaatctcaaagttaaaatgatcacgggagtggtgtgattcaatggatccgtttctgccccgtgggaactacaatttcacagatacaaatttgtaacatcttttttgatatctaatcaccgatgtgaaaatttttaacatttttaaaccgttttattatgaaaaatttcaaatatacagcaaagttgaaaggattttacagtgaactcccatatactcaccatcttgattccactattaacttgcttatcacaaatatatccattaatccatcttactttgtgacctatttccaagtaaactgcggagatcagtatacttcctgctaaacacttcaacatgcatgttaattaattagattttttttcccttcttggtgtaaaagttcatgcaatgaataggtgtgcatttgcggagtttgacaaatgcacatacctgtgtaatctaaatccctatcaagatatgaaacattacaatcactcctgaaaggtttcccaagcccctttccagtcaatccctacccttatttccctctctcagaataaatgtttttttgtttgtttggagacggggtctcgctacgttgcccaggctgtcctggaactcctggcctcaggttctgaggagctaggtctctaggcatacatagcacaagtgtttttgttgttgttatttgtttgtttgtttttgagacagtctccctctgtcacccaggctggagtgcagtggcatgatctcagctttctgcaacctctgcctcctggcctcaagcaattctcctgcctcaatctcccaagtagctgggattagaagcacacaccactacacctggctacttcttttgtatttttagtagagacagggtttcgccatgttggtcaggctggtctcgaactcctgacctcaagtgatctacctacttccgcctcccaaagtgcggggattacaggcatgagccatcatgcctggccacaagtgttatttttaacccacggcactttgaacaatcttcaagtctctggtgtgaagagacagtcttagaaaagtaatgtttaaaagggataaatagccaggcatggtggtgcatgcctgtaatcccagctactcgggaggctgaggcaggagaatcacttgaatctgggaggcggaggttgcagtaagccgagattgaaccattgcactccagcctgggcaacaacagtgaaactctaactcaaaaaaaaaaaggggggggtgacaattatattttaattataaaatagtaaatgaaaccatattcctgaagctaaatttaatacttacaaaaagttgcaaaaaagttatatctgttacatctttaaatgcatataagccatttaaatggtatcaatctaacagctaattttcaatgaaatgtttagtctcaaagaaggcataccgattgatatgttcaacacaagtattcttgtttcctaaaattctatttttatgaattcatggagacacaaaatatcctagagaagaatccttaccctgaaattgcaatttatctataatttatattccttgaatacctgggtttcccttctgcatataaccaaatggaatcctttcttggcaagaatggattgctgcctctactgtgaactgtagttacctggctctaactggcagacagataatttaacgtaaattagcagattatgcctgtgctctggtcctagaatattatttaagagatagcagataagagtggtaaatgatcaaccgggtgtttgctgaaacttcctggagggttaagtaatttattattaatttttgagactagctatagatgggaaaaatgagtcattctgattaaaatgacggtgcggggcaatcagccagctttagacactgctcctatatcaagtacatgccaggccaggagcaggggctcacgcctgtaatcccaacactttgggaggcagaggtggaaggactgcttgagcccaggagtttgagaccagcctgggcaacatagtgaggccctgtctctacaaaaaaaattttaaattagccaggcgtgatggtactacgtaactgtagtcccagctactcaggaggttaaggtgggaggatcgcttgatcctgggaggttcaaggctgcagtgagccatgattgccacactgcactccagcctgagtgacagagtctcacaaaacaaacaaaaaaaaacccacacgccaaaacatgttcttctgcagtatatggtagagtccacattttcttacaggactgaaaacctgacagtcactttgcctctagactacagttttaacatttttagttagtatataaatctgtacatataatgtaagctcaattacgtttttgaaaaattacacatactcccctaaaaaaagatccagaagaaaaagcaccaaaatgttaacagtgtgttatctttgggttatgaggttttagattgtctttattttccttatgcttcgctgtatttcccaaattttatacactgaatgtattatttttaaaatccaaaataaagataccggggaaaaaacaaaaccctaggcagtgactgacctgtaatgatcaccaaatgactgattttatcacactgtgattatgaagctacaatgaatgaatgccctttgtcctgatttatccttgctgccacccaaaggtacatataacctgattctcctggcaacaacacaccttggcatcccacttaccccatgtctgtaaagaggcctcagacagtaattcaaccatttaaaaactatgtcccctacaattatgctttctcactatcttcagagtattctcacctactgttttttttttaatgtattcactgtagtgtgccttataaaaacaataggtatgttgagtgtgctgtttctatttatacataagcctttcactcccatccaaaagaaaacatcccagcctgggcaacaaagtgagagcctgtctctacaaaagaaaaaaaaaaaagtagccaggcatggtggcgcgtgcctgtagtcccaactactcaggaggctgaggcaggaggatcacctgagcccaggaagtcaaggctgcagtgagctatgatcgcatcactgcattccagcctgggtgacagagcgagaccctgtctcaaaaaacaaaacaaaacaaaaacaatagaaaatatcttggtatcaccatatcatcatccaatgccaactttatgaaaattcctgatgtaaactggtgaaaatccttggaataacaactagaatgggactcagttgtagtgctggcattgcctaggaggctgagtatatcctttaaacctttccatgattctgttttcccacctgtaagatacaggggtaagcccaataattttgagtatcctttccactgaaaacctgtcacactgcctctagactacatttaacgtttttagttagtatataaaactgtacatataatgtaagttcaattatgtttttgaaaaattacacacaccaaaaaaaattatccaaaatgttgcgattcttcagatcctgttgtatcttacacagtcatgtgccgcataatgacgtttcagtcaacgactagctgcatatccaatggtgatcctctaagattataatactgtatttttactataccttttctgtttagatatatttagctacacatttacttacctacagtattcagtacagtaccatgctgtagagatttgtagcctacgaataataggctataccatacagccaaggggtgtaataggctataccatctaggttggtgtaagtacactccatgatgttgccacaatgacaaaatagcttaacaacgcatttctcaggatgtatccccatacttatgcaacatatgactgtgtttgtgaattcatcctgaaaacacatctgagattataatctcccaatagtcagaatatcaatcacggtagcaataacactgactgcatatgcttgccaccacagggactttgctaagttcttcactatcaggtagaaactaatatcaattccaatgaagaaactgaagttcgaacagaatggtccagtaactggcccaaagtcaccaaaccagtaagttgcagagcggggacaagagctaagaatcattaggctccacagctcattgcagtttctctctccaaggtgcaggctaattctccttgtcctaaacaacacaacacagtatctctaccttgctgtttctaaaggccctaaggtagatgactaatagggaagctctctacatctgatttctaggagtctaggaattctgagtataaacgtcttcactattcatggttacatatcatcaagaaacaagcttactttcgccaccactttttaagacattttccaaaagcctgctggcagcagtgtgcgcttatgctcaggtgactagctaggccccagaagtttagagaacagtgcaaatgaggttaaggtgccaggtggactccagggcaggtatgcagctttgcataaagaacaactctttgcataaggggtagcctcaggggaggttccccaatcccagaaagtgaccttacaaatgcctacccacaaacagttaatgaagggaacaaaggcacaacaaaattaatctctgcacctggaagataactcaaagtgacaggatggacacctcactttcgataattagccacctcattagatttacaaaaaaataacagaagtgagatgacctgatcaactaagctagcagaagtctaagccactcttccttgaaaagcagacagcttatgtaaacgtactttttattaacaccctaattttcacatttatttccagaaagaagttagaaaaagtatgttcctcatacttcaaagtgccctttctgtatagagaggcgatgtgcctagatgggaaaagaatgggtttacctaggcttcacacctacctaccaccgatttgcgcatctatttttcttttcccaactataacttttgaaagttatagttgggaaaactgtaacttcctcttcctaaatcaaaggcaaatcaaagtctgggcacggtggctcacacatgtaaccccagcactctgggagggcgaggtgggaaggtcacttgagcccaggaatttgagaccagcctaagcaacacagggagacctagtccctacaaaaaaattttttaaaaagtagctactggtcctagctacttgggagggtgaggtgggaggatcacttgggcccaggaggtaaaggctgcaatgaggtgtgatcacaccactgcactccagccttggtgacacagcaaggccctgctgagaagggaaagggaaagggaaaaggaaagggaaagggaaagggaaagggaaagggaaagggaaagggaaggcaagtttgctctaacacaactgataacacctgggaacaatatgcgcataacctgaactctgcctttgcatatgcacaatttcatccacgaggaaaacccagaaaactacacccagctggaaagacagacagatacacacacacacacacacacccctgaagcatctaccagctactcagttcaccaagtgggtgccacacacatctgatgttagaactctcaatgccatttcagagaaccctccttctaccacttcacaataactcaagctgcaaccctgctgatgctcacttctatgagcaaaccacagatttagattttcaaagtgccatatttacagtattccttaactgcttaacatgtgaacacctgcactgttttcattaggttctttttttttttttttggtgatgagtaactaatgcagtttttgcacacctaactccaatttttcataatctctatggcttttattgaacaatctggcatagtgcagtaattttttttttttttagacagacttttgctcatgttgcccaggctggagtggcacaacacacaaccccctacacaatccccagcccctttcagaatgtcttccacggaactggtccctggtgccaaaaaggttggagaccactgctttatatggattaactcattaaccacagggtgaagtgaacctatcatgacagtctgttgtggtttatttttttttttttttgaggtggagtcttgctctgtcgccaagctggagcgcaatggcgcaatctcggctcactgtaacctccacctcccgggttcaagcgattctcctgcctcagcctcccgagtagctgggattacaagcatatgccaccatgcccggctaattttgtatttttagtagagatggggtttcaccacattggccaggctggtcttgaactcccgacctcaggtgtttggcctcccaaagtgctaggattacaggtgtgagccaccgggcccggccagtgtggtcactgttagaaatgcttatgccatgttatagcagaactatttaatataatcacctttgtagaaaagaataaactgcatgacattaatgatattcccattctgtacatacagatacctttctaaagggtgggggtgggaaaagaaaacaacacattgagtttcaatctaatcatttccaacaactcagaagcaaagaaatatgctgagttttcattatgtctaatgcttccatgtgggatcttccaaagggctaagaaagcctggctcagcctagagaatgccacacaaattaactacagatttaactcctttaccgatgcaaaaggcacgctgtgtcacacagctgtgtatgaagaaacaatggaaataatcgcagtaaatgtatatagttaatgtgaccagggtagcccaactctttggtcctgctcaattgatttgacctatgtcataacagactctcaatcattcaaagtttactcactcttgacaaactagagaaaaaataacaatctagagaaaaataattactaagtccaaacaggtttctgagaagagctttattctactttgtggaatccaatcaaagaaagaaaaaaactaattagacatactgttgtaacatttaatgagatttgaaattcatctatttaaatttattaatagtaaaggaatgagattaaatagacttgacatcgaaggggctagaatttcccatgaagttttccacattatcggtaaagacagcaggtatgttttctttacagctttcaagaatcccttgccagaaataatcttatattaagacaggatgtttcgttatagtggggaaaacagaactggccaggaaaagatcttatagcaaagagattgtaaaagattattctagcacaaatacagatttaaattgctgccatcctttttctcccagcccagcaattcctgaggtgcaaaattttcaaatatctgtgtatacaatgacaaggacacaagtgaaaacacttgtgatgaaagggttatgaataaattactgcaatttccttttatcaaccaagttgatttaatggtttaaaaatattgttcaacagaacaaaggtggtaacatttgttagatcctaattaaacgtgattcattctggaatgtttctgatgacacagcttacataaataatctactgggaagtctactcaaaattcacaatgaagagtcggtttttcacacatataatacaacctgaaactatagcttcaatctatgcagatggttttactattttaattatacaactaattaataccaaaattagatcgatgttgtttaatttgtggctactgaggaatgttactattcacaaatcacaaaatctgtgccaaaataagtcttcaaagggatattgttgcctccttacccttctaagctttgcagtgggctttggtcaaagctgacataaacagctaaagaaattaacaacagagtctcagaagacaaggccaggggagccaaaaggacacaggtgctacacacccaggcagttgttgtctgctcccagagcacctgacttcagcagccacagcacctgctcctcaagcgcagcggcgcctttgagggagcacagcctggaaggtttacccttcgcagagacgcttgctcttggacttctggctgtacattctgagggttcaaatgaaggatgggacaatgggaaagcttaaatcctctggaaacgtcactgtgatcaatggcttcaaccctcctctacctcataccagttcactggagctgctaacactaagtttccttctttatccgcccatctctattccagtggagccccgtgattaagggatggcagaggaaggggacatgtccttttttttttttttttaacagaaaaacactcatttagatacctggtttagtaagacatctgaacaacatgaaacccaactatgtaaaagctttaaaaatccaggttatgaattagcctaaacctgtgcttatgttccattctgtttagaggaagggggatggaatccctttcacctttatatttttcatgacaagtccatggtcacatcaaaaattacttttgtctttaacacagttgaaattattaaatgttatctagacctaaccaaatcctatttccttaatgttatattcaggacagtgaaaaaaatactgttttcttttagcaaagtctgacttttaaggctcagtttttacctgattaaataaactgcccctgcttttgaggttagaaaaattacttttgttcatggggtccattatactgtactattaagtttacttttatatgtttggaaatttccagccgggcgcggtggctcatgcctataatcccagctactcgagaggcagaggcaggcagattacctgaagtcaggagttcaagaccagcctggccaacatggcgaaaccccatctctagtaaaaactacaaaaattagccgggcatggtggcacgcacctgtaatcccagatactcgggaggctgaggtgggagaattgcttgaacctggaaagtggaggttgcagtgagccgagacggtggcaccacactccggcctgggggacagagcaaaactccatctcaaaaaaataaaaaaagaaaaaagaaaatttccataataaaatgaaactcttaaggaaaaaactgctttgaacataaagccaacccaaaaagtagctcttacctaaagtgaattttccctagtgccaaatgaaattcaaataaatcccaatcttctaattcacacaaatcttaagatttctaatactttaaaccagaatgaaaaagtcaggtatgccaaattaacaatcgaagagaaaattaatcccacaccaaagccaaaacattgaacttcctcccactctcgcattcacacacacacacaagcatgaaccacacaatgaaggattccagttgccccatccagacaactggacgcacatcacacacctcctagtcatccagggaccatcttggcagcctgtttctcatcactacctgccaccctgtgcctgtgttgtggacgaggaaggcacgggtagtagcctagctttttatttttttaaatctcagcaatagaggcaaggttatttctaccttacatccaagagtatggagcacaagactagctgtttattaataacatgcttattttccacaccaaccacacggttttccaatttcacaaagtaaatacttcctcatccctctttagaaaagatgaaacaatttatcgtagcctaagcaaaaaccacctatcaaagcaaagactggcaagcagattcaagacataaaggtatagcttttactataaatttgaaaccaacaagaaagccattaacctaaatatttttctaatcaaaaatcagaaatgacgttaatagcaacatataagaattactgtatctaccacacttagaatgtactggggtagatgacaatgacaatcagtactgattgccttatgtttatcaactttttcatctacatttcaggtttcagtgcaagacaaaccattaatacattcatgactagccatttcaaagcattattgtatacatactgtacgacacaaagtgcttaattgtaacttaaaaggttaaaacccatcttgaatcctaaatgggcaaaaaaaaaaaaaaaaaaaaaaccccactagtcatttgcccacaaaccaggccccatataaccatcaagcatctgactgcatcggacatgattaatctgaaactgtgctatgaatcatacagcagtcctcccttatcttcaagggatacgttctgaaattccccagtgggtgcctgaaactgcaggtagtaccagatctaaatacattgctttttcctatacacacatacctatggtaaagtttaaattataaattaggcacagtaaaagatgaataacaatgtaaaaggaaaataaacttggggaccccaaacccactaagtcaaagagaaaagtcaaggtaggaacggcatcatgcaaacctacctccctcacaatctgcccaataggaaattccttgtggacctcaacatccttaccctacaaccactctgctgaatttcaccctgacaacgtaaattgacagcttatcttcacaggtataggacaaaggacagaacttaaagtcattcctctgcttacctgagacaaatgcataatctcatcacttcctctgcccggtaagtatattttgtcttatgtaaaaatgcagattcactgagctagatgaatgcataagggactattcctccgctgccccccacccttgcccgccacatgtgaatagctgatcaaagactcaaaagaatgtaaccatttgcctcctatctaccacgccttcctaaaatttctccccctttaaatactgaagccctcaaaatcatcttaggagaaaggcacagaccttgggcctgggtgcatgcccttaaccttggtaaaataaacttctaaataaattgagacctgtctcagatactttttggtttgcaacaaatataaaatggttttacaatttggtttacaacaacaacaacaacaataaaatggaacaattataacaataataaaagtaattaagtaaagttaatttttctgagagagtctcactctgttgcccaggctggagtgatcatggctcactgctgcctcaaactcccaggctcatgcgatcccaagtagctggggctacaggcatgtgccaccacacctggctaatttttatttgtatttttgtagaaacaagttttcccccaggttgcctaggctggtctcaaactcctgggcttaagcgatcctccagcctcggcctcccaaaatgctgggattacaggcatgagccaccacacctggccataagattaaaattcaaaagtattacaaataataaaattaaaataagggtcacttgaacacaagcactgtgacaccacgatgatgatgtgataatccagacgactactaaatgtgtatacagcgtgggtatgctggacaaaggaatgactcacatcccaggcaagacaaagggggacagagcaggatggtgaaagatttcatcacgccactcagaatggtgcacaatttaaaatttgtgaaatgtttatttctggaattttccatttaatattttcagaactcagtgaaaccacagaaagtgaaactctggataagggggtgactaccttattcactatcattcctggcaattaaagaatgttaactccaactgaacaccagatgaattggccctcaattaaacacatctgtccagaaatataaaatcacccaaaactaaaaatttactaaagtgaagcatgctccttagaagacttaaaaaataacagtgatacactgtctgctttgttcatcactgtatccttcaagtctagcacactgtaggggtgttacacagagattaatgaatttagctataagaaaatagcaaaatcaggcaaatgcaaagatgagtttgtaattttttctcttttatcacaggcaccagaacataaaagttttctaagtacccacccctgcctttaatcaccatttttatcactcacatttagataaatacatttgcagttcagctgatatcagaaaaaaaaatatgtatcaaattgtcaaattttactaagtcagagctgtgggagtccagcagcttttacacgttagatttttctatttcctcattcgtcagcatttgacatcattttctgatgttataaaggataacagaaaaaaaaaccctgtgcacacatcacgcccctcctagtcatctagggaccatcttggcagcctgtttctcttcaccacctgccaccctgtgcctgtgttgtggacgaggaaggcacggggaaacagaatattctggtgaataaagcattactaattttcaaagaattagaaggcaaaaacaaacaaaaaaaacacccacaataccaaactgaaagtcatgcctcagggtctttattgtaactacttaatactaaacaccaaaacataaatgatgctgattaatggagatttggggctaagaaaataccaaacaggctaggcgtggtggctcatgcctgtaatcccagcactttgggaagccaagacaggtggatcaggtgttcaagaccagcctgaccaaaatggtgaaaccccatctctaccaaaaataaaaaaattagctgggggtggtggcatgcgcctgtaaccccagctactcaggaggcggagacaggagaatcacttgaacctaggaggcagaggttgcagtgagttgagatcatgccattgcactacagcctgggtgacagtaagattccacctcaaaaaacaacaacaaaaaaaggaaataccaaacaaaatgtgcttttccctatcttcgaaatcatcatgtcttttcattcctgtatggcaaaaaataaatcccgtgtcgcctgccgaatccgaatctaaataaatgaataaagacagagaataataaagaaagaaaacagcttcaaacttaaacacgttagagcaagagaaacaaacaaacaaaaaaaaccatgactcctgctttctcaaaaatcacatcagtagcttataaagaccttcatgggcagaaaaagaatgggcacactgtagggagcaaaaggtaagtgataatatttacaaagtagtgtattttaaaagcataaacaaaaaattaggtaaattgggcctcattaaaaacttttttgtgcatcaaaggacactatcagaagtgaaaagacaacccacagaatagaaaatatttgtaaatcatgtatctgataaaggtttaatattattcagaatccgtaaagaactcctaacaggccgggcatggtggctcatgcctgtaatcccagcactctgggaggcgggggtgggaggatggcttcagtccacgagtttgagaccggcctgggcaacatagggcaatcccatctctacaaataatgtaaaaatcagccgggcttgctggcacgcactggtggtctcagctgcttgggaggctgaggtgagagaactacttgagcctgagaggttgaggctgcagtgagccgtgatagtgccactgcactccagcatgggcaacagagcgagagtccatctcaaaaaacaaaaaaaaaccctaaaaaatagtgattactggccaggcgcggtggctcacgcctgtaatgtcagcactttgggaggctgaggcgggcggatcatgaggtcaggagatcaagaccatcctggctgacacgatgaaaccccgtctctactaaaaatacaaaaaaattagccgggcgtggtggtgggtgcctgtagtcccagctactcgacagtctgaggcaggagaatggcacgaacccgggaggcggagcttgcagtgagaccagatggcgccactgcactccagcctgggcgagactccgtctcaaaaaaaaaaaaaaaaaaaagtgattactgcataacattatgaatgtaatttatgccactaaactgtacacttaattacttaaattactaaaatagatacatggcaaatttcatattttaccaccaaaagaagaaaaatgtacaaagtagatttggaaaaaattaattcagtcacttcaaaatcaggattaattaattcctttccccaaagtaaatgcagtccaacgaccaagaggctggtctgcccagacaatagtttcttctttcatttcattaaatatttaagtacatacaacgtgctgggcaccatcctaggcacaaggaaattacaatccagaaaacttccctctcatgactatatagattatgaggatatgggtcaaatgagcttttctaaaaaagttaaagcattaaatgcttttatttaaaacatacagattcagccgggcatggtggctcaagcctgtaatcccagcactttaggagcccaaggcaggtggatcacctgaggtcaggagttcgagaccagcctggctaacacggcaaagccgcatttctactaaaaaaaaaaaaaatagccaggggtcatggtgctcgcctgtaatcccagctactcaggaggctgaggcagcagtatcacacgaacccaggaagcaggggttgcagtgagccctgatcgcaccactgcactccagcctgggcaactgagtgagactccatctcaggaaaaaaaaaaaaatacagattcaaaataactatatcatgaatcctaaagtcagtctactatcatttttggtctatctggtttgacttccttaggttggcaattctgtcatttttctgaacaggaataaaacatttttttcctttttcaattacataagcaagacacaacacagtatttaggaaaacactattttatgaccttcaccagccaagtctaccaatcagcaaatacacacatcctgatcaggaatacaatttaggcttggttcctgaaagtagaacttaaaatgggataatgagcagctctgtgaggaaaaaataaccctgtctctccatcttcccaagcttatgattgttcaacacagtagaattaagaagaaggtttaaatgtcaattatccatacttttaggactacttgggagggggtggaaaaagttacctctttactgatatttaaatatcctacaactttttaataaaaataatatacagttgtgctcactagcataccctggatccactgacatgtaaaaacacaacattgcggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactctgtctcaaaaaaaaaacaaaaaaaaacaaaaaaaaaccacaacattgctgtcttacaacctactctttccggtacccaatactccacaatatttttcatctttataattaggctactaaccacctaagagaactgttcataattgatgacagtaatgaaggtgcctcagaaacaatgaacaggttcgcttctgattgctgcaaagtacctgggtagctccgtcacctgcaaaggcagaggaacaatacccagggtctaataattgcttactcaaactaacaaaaggagaaaaaaaaaagaggaagtagagaaggggcagcactctaaattatttaatgtgattcccatgcttgggaaaacactgaattcatgcaaccagcaggagctggaatgctcctcagtataaaaggcaccatataaaaagaattactgaatccaaatgcaatattcattttcatttaacatccaactacctagaggattgaggtaatgagtctggggctctatttcacacttaaaagctgaagtgtgaagccagaggaaaggactggcttagcagatcaaaatgtaaaaggattagcccacaggacaaaaaaaatggtccaaaaaaaggaaaaaatggtcttaacatcccaaagatatttccaaaaattctttctgattttctttcctttgaccaagacagcacaattttccctcccttccttagtgacaatgatttcaaagacagatttccatgtagagacacgaagtctggagttcccaggctaatgtccgaaagcaatggcactgcacagtggggaccttgccattcaccccaaagactgaaactataaagtctgaagattacacacaagcatgtcaccattctcaccgcagcagtctggggaggagatgaagtcaacgggaaatcagaactttaaaagacagtgtctttacttgacaaaatgattccttctttacttcaaaggttcaattcacacatgctcagaatcatgaaacttcagatctgaaagggaccctagaatctgcacaatagtccagtctcctcagttcacagaaaacaggaaaaaaaattcatacctagttattggtaaagtcagacaggagcccaaacctaatctcagtttaatatgagcatgagaccaagagggcacctcctatggttataaataagaatcataaggccgggtgcagtggctcacacctgtaatcccagcactttggaaggccaaggaggacggatcacctgaggtctggagttagagaccagcctggctaacatggtgaaaccccatctctactaaaaatacaaaaaaaaaaaaaaaaattagctgggcatggttgcaggtgcctgtaatcccagctactcaggagggtgaagcagattgagaatcacttgaacccaggaggcggaggttgcagtgagccaagatcgcaccatagaactccagtctgggcaacaagagagcgaaactccatctcaaaaaaaaaaaaaaaatcataaacataaggacctttgtgtcaagctctgtgctaagcccttttatgtgcatattctacttaattctgacaagtagcctgagaaaggtagtatcctctatttgaaaacaaaatgaatctgcccactccaagctgatctgaacccagatctcttttcaaccacattgtatgtgcttcaggaatatcttaataattctcaactttgggcaagttaatgactcaacttgacttatatgatcatctataaattgacagatgtagtcaaaagtttagaattcaaagatc

SEQ ID NO: 200 - DNA, 683 bp, Homo sapiens
  misc_feature (416)..(416): n is a, c, g, or t
  misc_feature (430)..(430): n is a, c, g, or t
  misc_feature (518)..(518): n is a, c, g, or t
  misc_feature (536)..(536): n is a, c, g, or t
  misc_feature (539)..(539): n is a, c, g, or t
  misc_feature (545)..(545): n is a, c, g, or t
  misc_feature (550)..(550): n is a, c, g, or t
  misc_feature (624)..(624): n is a, c, g, or t
  misc_feature (676)..(676): n is a, c, g, or t
ccagttgaaaactatgcagatgtttttagacaagagcaaaacacaacacaagtacccaaaaacggaggcagcctgcatgctccaggtctacacgagcacctcacagcctgacaaggggcagacagcaactcacacgggacgagcttcagcacacagacagcaaagcaaatacgagacttagactgaactgcaaagagggaaagggccatttcaccaatggagtaactgagagaataatgacttagagcccaatctgcctgccatctccctgagccgtcacccgtcactgaagatagcgcgagggtgatgcttcaactcaccatcctaagggtttgtgtacaaacacactcgagggcatctctttcacagaaagaacaaatgtcatttgtaccaaatggcaatggattttcagcacnaacttagtacttcnctaacactacagcaatagtaatcatctactttcagcaagagggactcctttaaacaaggaaaaagactcacattaattagcctatgtncccactggatcaatctgnagnaacaangtctngtgctagcagacacagggacagagggaccagctaccctcaacacagggtcaggagagccgggtcctagactganccctctaagaaggcccatgtgtccaaagagaagagctgtcaagaaaaagaanctagtca

SEQ ID NO: 201 - DNA, 1504 bp, Homo sapiens
ccacgctcgtgccgccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagatggaaaaaaaaaaaaaaaaaaaaaaaaaaaaaaaaaaaaa

SEQ ID NO: 202 - DNA, 599 bp, Homo sapiens
ttgtggcacataatttgtttaatccagattggatacatcaggtacagcagtggcacacgactcaatactgtaaatgatatacatgttttaacatatgcactacagtttcaaaagaagacgacaggaaactcaagggtgtattttttttttcatagaaagttttcatgttttatcttcctgcagttttgtacagtatatttcttctttgccattgtgatgttgataagcaaagcccatttattatacgaaaatagaaaagaacacacttgatgtatctcacgatgacattaatggggggaagggtgtgacctctaaggaaaacattacattggaatgtctgattatcacaaatataccatccctcacacctcccaggtttgtaaaatagtccattggtccaaggagcaccccaggacttgggtcagtgccgtacactggttagagtgacatcctccagtgtagttgagtaacctgctaagataaatgtcattcccaacttgagaaaaacacagacattctgaatagaaaccagacttaaaggaccctttaagctgctcatttctgaagcacttcccccgtgcgaatcttgcccggggcaa

SEQ ID NO: 203 - DNA, 1327 bp, Homo sapiens
gcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggtctcca

SEQ ID NO: 204 - DNA, 1201 bp, Homo sapiens
atagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccgtgcatctgtactccccttgtgccacacattgcattattaaatgtttctcaaacaaaaaaaaaaaaaaaaaaaaaaaaaaaaaa

SEQ ID NO: 205 - DNA, 1542 bp, Homo sapiens
ggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaacttctgtta

SEQ ID NO: 206 - DNA, 5718 bp, Homo sapiens
ctcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacaaaaa

SEQ ID NO: 207 - DNA, 560 bp, Homo sapiens
tggtgtcacatccatttattgtccatgaggctacagctccattctcagggccaggaatgggcaagcctgcccagtgtgccattcctgcctcccagctcttaccctggaggcctaccatggtgccagcctggagctctgcctgtcctactgggaccgagcagacagccccttggcccaccattcgtaacacagggacttggctggcctcaccccactggcggggtctcctccagtgctgacaacacttgccggtgccttaagtttggctgcaccctcctcctctttcctagtgtggctcatgctggctaccgggcacttccccatccatggccagtttgcaagattggctctgccttggtccaagttcctggggttgtccaagagaccaccctcggtcccggatccacttgcaagcccaagcttccagcctagaggtctttaggacgcctgtctgagagacgacagtgcttcccaagctttcatgcccaccctaggcctcccaattcctgcccttgccgggctgcactggtagggtgggagagtgggcaattaattctagc

SEQ ID NO: 208 - DNA, 4593 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagtgttaaaaaaaaaaaaaa

SEQ ID NO: 209 - DNA, 3992 bp, Homo sapiens
ataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaaaaaaaaaaaaaaaaaa

SEQ ID NO: 210 - DNA, 1745 bp, Homo sapiens
ccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctc

SEQ ID NO: 211 - DNA, 844 bp, Homo sapiens
ttaattattacttgcaactcaacagatctccctgccgtactgccttttccaggaactttacttcagggctgtccagattgcagttgtgccccgtgtatgtggatctagttcacagagtcttggaagccagcagtcgtgccctccgtatactgtccactcattttatgtagatttggtatcctcagcagccagtgttaacaccactgtcacgtagttgtacagattcatcttttatgtatttaaagtaatccatactatgatttggtttttccctgcaccattaattctggcatcagatcagtttttgtgttgtgaagttctactgtggtttgacccaagaacacaaccatgagaccctgaagtaaagataaggtacacatacattatttgagtaactgtttccttgggggccaatctgtgtatgcttttagaagtttacagaatgcttttattttgtctataacaaacagtctgttcatttatttctgttgataaaccatttggacagagtgaggacgttgccctgttatctcctagtgctaacaatacactccagtcatgagccggggtttacaaataaagcacttttgatgactcacaaaggatgaagtcctttttttcctctgtcccaaatggtgtgtctctggttccaaacacatttttaaatactcggtcctgacagggtcttagctaatcctttgagaattaaacgggatttgcaaaacaacaaacgaacaccgaacaccacgggaaaaatcgaaagggaaaccgaaaacaaaaaggcgggggcggtatcgtggcgggcaaacctgggaaagggacggagtaaaaacggcgcacggcg

SEQ ID NO: 212 - DNA, 778 bp, Homo sapiens
acggcggctcagatcacccagcgcaagtgggaggcggcccgtgtggcggagcagctgagagcctacctggagggcgagtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtgatggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtcca

SEQ ID NO: 213 - DNA, 2490 bp, Homo sapiens
atggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagtcctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactag

SEQ ID NO: 214 - DNA, 10716 bp, Homo sapiens
catcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatgggacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtatgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataaaaaaaaaaaaaaaaaaa

SEQ ID NO: 215 - DNA, 904 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaagcagtgacagtgcccagggctctaatgtgtctctcacggcttgtaaattgtgaaacagctgccctgtgtgggactgagtggcaagtccctttgtgacttcaagaaccctgacttctctttgtgcagagaccagcc

SEQ ID NO: 216 - DNA, 819 bp, Homo sapiens
actcccaaaagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacttggaaatcatgacaaagcgctccaactatactccgatcaccaatgtacctccagaggtaactgtgctcacgaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttctta

SEQ ID NO: 217 - DNA, 566 bp, Homo sapiens
gccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaaaaaaaaaaaa

SEQ ID NO: 218 - DNA, 803 bp, Homo sapiens
ccggcacgagaggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggccacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagcattctcactgtgaaaaaaaaaaaaaaaaaaaaaaaa

SEQ ID NO: 219 - DNA, 1642 bp, Homo sapiens
tttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagggaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactca

SEQ ID NO: 220 - DNA, 1541 bp, Homo sapiens
ccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaaaaaaaaaaaaaaaaaaa

SEQ ID NO: 221 - DNA, 2023 bp, Homo sapiens
tttacttcctgcgtccccggacgccgtatgtggaaaggcgaaccctgagtggaggatgttcccgctgcctaaagaatgattgactgtgactgcacttttgtgagattataaatataccacggagggtaacgaagctacagaagaatggaagaagacagcctggaagactcaaacctttttccaaaagtttggcattctgagatgacggtgtcagcgacaggcgaaccacctagtgccgtcgaagaagaaggaatacctaacgaaacagacatagaaatcatgccagaaatcccggaaactctagagccactgtcccttccagatgtgctgaggatctcggcagttctggaggacaccacagaccagctctttattctgaactacatcatgcccgttcagtacgatgggagacagagcatctgcgtgaaaagcagagaattgaatctagaaggaacgaatctagacaaacttgcaatgggcctcaacatgacaaaaatactcagtccgttactacctgtggaaggacccaatttgcctgatttcacacccagaggccggttcgctgtggagtttaacaaaatgcaggatcttgtcttcaaaaaacctacaaggcagaccatcatgactacggagacactgaagaaaattcacattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagattttgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgtcttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaaaaaaaaaaaaaaaaaaaaaaaaaaaaaaaaaaaaaaaaaaaaa

SEQ ID NO: 222 - DNA, 931 bp, Homo sapiens
tttcgtcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagaaaaaaaaaaaaaaaa

SEQ ID NO: 223 - DNA, 1851 bp, Homo sapiens
tgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagtaaaaaaaaaaaaaaaaa

SEQ ID NO: 224 - DNA, 1501 bp, Homo sapiens
agcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 225 - DNA, 1691 bp, Homo sapiens
gtgactgggtggggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaa

SEQ ID NO: 226 - DNA, 7680 bp, Homo sapiens
gaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 227 - DNA, 2412 bp, Homo sapiens
ccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctgcatgagcaatttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttaatacattatatgaaaatctagaccagagttattaatattcaaattactccttaaaagtgaaggcaattgttttctatagcagaattaaaataggcaag

SEQ ID NO: 228 - DNA, 639 bp, Homo sapiens
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaa

SEQ ID NO: 229 - DNA, 826 bp, Homo sapiens
  misc_feature (493)..(493): n is a, c, g, or t
  misc_feature (628)..(628): n is a, c, g, or t
  misc_feature (774)..(774): n is a, c, g, or t
  misc_feature (781)..(781): n is a, c, g, or t
tggaaaacaaatatacaacttggaatggattttgaggcaaattgtgccataagcagattttaagtggctaaacaaagtttaaaaagcaagtaacaataaaagaaaatgtttctggtacaggaccagcagtacaaaaaaatagtgtacgagtacctggataatacacccgttttgcctcgtgccgaattcggcacgagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgattcttatatataaatattatataaataatgtataaaacattanaagttaactatgtaagatattatttctgaaacaatttagctatatccactatgattataaactgtgtctcgacctgtgttatttacattagctgcttaaaaaagcattgagttaattcttttaaatatcaactancatatcatagttctgtggtagacattgccttataatgaaataactgcaactagagaaaactgtataaaaacattaacatggtagtatttttggaggggttcattttgtaaagagaataatattcaaggacttttgtagcataccanagtgaanactttgatctgcgaaactatacttggattaaatgtgctttttaat

SEQ ID NO: 230 - DNA, 1812 bp, Homo sapiens
gtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaggggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaatgccaaaaaaaaaaaaaaaaaaaaaaaa

SEQ ID NO: 231 - DNA, 818 bp, Homo sapiens
ctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtga

SEQ ID NO: 232 - DNA, 2035 bp, Homo sapiens
cgagccccgccgaaccgaggccacccggagccgtgcccagtccacgccggccgtgcccggcggccttaagaaccaggcaacctctgccttcttccctcttccactcggagtcgcgctccgcgcgccctcactgcagcccctgcgtcgccgggaccctcgcgcgcgaccagccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatgggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagcgaaaattgcactaaatgaatctcgttccaaagaactaccccttttcagctgagccctggggactgttccaaagccagtgaatgtgaaggaaactcccctccttcggggcaatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggggcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaaattgtt

SEQ ID NO: 233 - DNA, 2960 bp, Homo sapiens
tttccaaggaaggaaaggcacacaatggtatcaaatgttcattcattccatctcttgatgctctacgatattatcagtctacactatgctttcctgaaaggccagaagttcaaagatggactagtttcccagggacctgattccccagttggaatactccagccccttggaaattcccgggatttataaaataactctagacaacaagactttgtctttaaaggtcctatgaattcttttctctctgtatttaggtatcctgatttttcttttccatattttccacaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtctcaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatyttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatctctgttttatgtcctgtcctcatctcttaagctaaatctgtttggatcatattaataaacctcgtgccg

SEQ ID NO: 234 - DNA, 4597 bp, Homo sapiens
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagccttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatacttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttc

SEQ ID NO: 235 - DNA, 601 bp, Homo sapiens
  misc_feature (38)..(38): n is a, c, g, or t
  misc_feature (506)..(506): n is a, c, g, or t
  misc_feature (536)..(536): n is a, c, g, or t
  misc_feature (566)..(566): n is a, c, g, or t
cagtaataatcagaacaatatttatttttatatttaanattcatagaaaagtgccttacatttaataaaagtttgtttctcaaagtgatcagaggaattagatatagtcttgaacaccaatattaatttgaggaaaatacaccaaaatacattaagtaaattatttaagatcatagagcttgtaagtgaaaagataaaatttgacctcagaaactctgagcattaaaaatccactattagcaaataaattactatggacttcttgctttaattttgtgatgaatatggggtgtcactggtaaaccaacacattctgaaggatacattacttagtgatagattcttatgtactttgctagataacatggatatgagttgacaagtttctctttcttcaatcttttaaggggcagaggaaatgaggaagaaaagaaaaggaattacagcaatactggttccttcctataggaaggattagatatgtttcctttgccaaatataaaaanaattaataatggttaccaccagtgaacccnaggtattagggaaataatggtccagcatcncttgccagaaaggggtaagatggttatgggtgaac

SEQ ID NO: 236 - DNA, 673 bp, Homo sapiens
ttatggccggggatgccttcatctgtttagtcatctccaaaaacagtaaaaataaccactttttgttgggcaatatgaaatttttaaaggagtagaataccatatgatagaaacagactgcctgaattgagaattttgattttttaaagtgtgttttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacagaaaaaaaaaaaaaaaaaaaaaaaaaaaaaacatgtcggccgcctcggcccagtcgactctagactcgagcaagcttatgcatgcggcccgaattcgagctcacttggccaattcgccctatagtgagtcgtattacaattcactgcccgtcgttttacaacggcgggactgggaaaaccctggcgttacccaacttaatcgccttgaagaaatccccctttgccagctggcgtaatagcgaagaggcccgcaccgatcgcccttccaacagttgggcaacctgaatgccgaatggaaattggaagccgtaataattttgttaaaaatcggcgttaaaattttggtaaa

SEQ ID NO: 237 - DNA, 3546 bp, Homo sapiens
gcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaatcttattgatgaagagaaaaaaaaaaa

SEQ ID NO: 238 - DNA, 537 bp, Homo sapiens
ctctcatcacttctgagcacggagcaatggcctctcgctgggctgtgcagctgctgctcgtggcagcctggagcatgggctgtggtgaggccctcaagtgctacacctgcaaggagcccatgaccagtgcttcctgcaggaccattacccgctgcaagccagaggacacagcctgcatgaccacgctggtgacggtggaggcagagtaccccttcaaccagagccccgtggtgacccgctcctgctccagctcctgtgtggccaccgaccccgacagcatcggggccgcccacctgatcttctgctgcttccgagacctctgcaactcggaactctgaacccagggcggcagggcggaaggtgctcctcaggcacctcctctctgacggggcctggctccacctgtgatcacctccccctgcttcctgctgctgtggcacagctcactcatggggtctgaggggagagaagcacaccaggggcgccctctgccttccataccccacgcttataaaacataactaagccaagagtgga

SEQ ID NO: 239 - DNA, 2116 bp, Homo sapiens
atcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgaaaaaaaaaaaaaaaaaaaaa

SEQ ID NO: 240 - DNA, 3775 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctcggtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcccaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaaggcagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 241 - DNA, 160004 bp, Homo sapiens
gaattcagagggttataataatcctgggagagattcaggatccaaactttgggttgacttatgaaaccagatgctccattagagactgaatttattttgccgtgtgggttgatttctttttctttgctccaaagagaaagatacctgaacatcacctggggcatcctaaggaaggtgagtccctgagcctggatccctttgggagtggatgggtcccatgaaaaatcttgtttggggctgggtgcggtggctcatgcctgtaatcccagcactttgggaggccgaggcgagtggatcacttgaggtcaggagttcaagaccagcctgtccaacatgatgaaaccccatctgtactaaaaacacaaaaattagccagctgtagtggtaggtgcttgtagttgtagctacttgggagactgaggcaggagaatcacttgaacccaggaagcagaggctgcagtgagccaagatcatgccactgcatgccagcctgggcaacggagtgagattctgtctcaaaaaaaaaaaaaaaaaatcctgttttgcctctcttggaaataagaacaggcaatgccattgacccataaaagaagtataatcaagcattttgagttctaagatttgtaaaagaaaaagctcctgggcccaaagagaaaacacacccctttttctgcaggaaagggatcagtttgttcaggaacaagaggtgccaaaccctgggataactggtaccctgggaaaggcctgaatgtggcactgagagagttgaactcaacagctgccagcagaggaggccacaccttgcacactgggaaagtccagcacccctgagaaggcagcggtagacaaatgagcgaacagtgcatgatccttgcagtatagagtggatcagcgtcacctgctgaactgtttacagccagatttcaaaatccacaccatgggctaatgagaaataacagcaagaggagattaataaatcaccagtgcttccttcgtaggggtggaaatcagactgaggactacataagcctcaggcaactttgagtaattcaacaggggaaagctcagaaagatattctagatttcccactaatatagcaagctggtcacatagcaattaactggaaaaaaagagatgtaatcatatctggactccaaggttactatctcagtcatgcctgttactttttgggggaaaaaaaagcctttttaatcagggttaggaatacgattttcatttgttaagtattgaatttgtaacagtgatgaggggtaaaagagcaaaattttatctgcctttgtttctttaaattttgttcaggaagtgtataatctccagtgggggcaggggagatgtataatgccttatttccttcgtttaaataaatagacattatttttatgttttagggcctaataaaaaaaatagttcagattaggattgcaggttaaaattagccttggccaaatagcacgtatctgagagcagcggattctaattttaatcacagggaatagccaaagaagctggaaataaaaattcaacaataaatatgtatttccagagagtttaaaatatttacaaaaattcctaattacacctcaccattttgatgtaatttctgaggatatatttttaggactttgcatttctttctattctttctcttcacaattaaatccatagatatccaccttgcattccaatgaagttaaatctacccccacttggtttccatctttgtctcacgtgtgttatttgtgaaatttatcactagtattaatccttctctctcttttttttttttttttgcttcatttggcattcgcttttctaaaatattaaggggtaaacattaaattaaatattcaaataggtgcacaaatactgcaggagagaaaaacctaacaattctgttgaaactgagctgttacctgacaggtgacacacagcacaacatagctcacaattttttttggttcaacgatataagcaaatccaatgtgcaatttgtaaggcaggcctaaagtgtcagtgcataatttctggaagaatatgttatagtacaacagtcaaatgtgtgaaagacaacaaaatatacaaagacaaataaatgacctctggaaggttaaaattctaagtcaaagcctccaaggatttggacacatgctgagcagagagaagactcttcatttctcttgactgttttgtaaggcagtaaatagctcaagctccagactgagcagtgaggagctaatcagctcttttcctcccaatcacccaaacccctctgcctctctcccaccccaaagctaagcccagcaggcaaaccaagaaaacaggaggctgtgattatccaaagtatgcctgtagtaagtccaacctgagcccgccattaaagctgttcatctcttagaaagaattggaaactgggaacattttctctggtttcactagcagaaaaaatgcaatcggtaatgaagcagaagcaccatgtcaactgcttaaagttcactcacatttaacatttcacacaccatttacattccagttctctctccaccaagtggaaaaggcaatggtgccctttggggcttagcaggatggttggatctccttgaagtgcttccctctctgtcactcttccttttcttcatttctcactcagtggtgagagatcttgatgccaactggaaccacctgtacctcagtgacccacctgagcaccaaaaaatcacacaggttcttctgccatgagtgaaagagcaatgagcttacagagctaagtcccacttagcttttcaaatatctttatgtactctgaagagcctatatttgagttctgaagccaggatttcttgtcttgatccatgaaatctaacctgctgcactagatttacctaaaaggtattccaaaaagattttacgaataatagcaacatttataaaagaagaaatgcaagtagccaacaagccaacaaacacatgaaaaaacgctcaacatcactaatcatgagagaaatgcaaattaaaaccatcctaagatatcaccttacactaatcagaattgacatatatatatatacatatatatatacatatatatatacatatatatatacatatatatatatacatatatatatatgtatatatatatatgtatatatatatgtatatatatatatatatatattcgagatggagtctcgctctatcacccggtgtggagtgcagtggtgcgatctcagctcaccgcaacctccacctcccaggttcaagcaattctcctccctcagcctcctgagtagctggttttacaggtgccccccaccataaccagctatttttttttttttttttagtagaaaaggggtttcaccatgttggccagggtgctcttgaactcctgacctcaagtgatccacctgccttggcctcccaaagtgctgagactacagcagaatggctattattaaaaagccacacaacaacgatgttggcttggatgtggagaaaagggaacgcttatatgctgctggtggaaatgtaaattagttcaacctctatggaaaacatacagtatgagaatatctcaaagaattaaaaatagaactactattcaacccagcaatctccctactcggcatctacccaaaggaaaagaaagcctataaaaaagacacctgcactcagatgtttatcacagcactattcacaatagcaaagtcatggaactaattaagtgtccaccagtggtgggtcagataaagaaaaggtggtacatggccaggcgcagtggctcacacctgtaatcccagcattttgggaggccgaggcaggcagatcacaaggtcaggagattgagaccatcctggctaacacggtgaaaccccgtctctactaaaaatacgaaaacaacaacaacaaaaaactagccaggcatggtggcaggctcctgtagtcccagctactcgggaggctgaggcaggagaatggcgtgaacccaggaggtggagcttgcagtgagccgagatcgtgccactgcactccagcctgggtgacagagcgagactctatctcgaaaaaaaaaaaaaagaaaaggtggtacttacacaccatggaataccatgcagccataaaaaaacaatgaagcatgtcctttgcagcaacatgggtggaactggagactattatcctaagtgagctcagaagcagaagatcaaatatcatatattctcacttataagtgggagctaaacaatgggcagacatggacatgaagaaggagataacagatactgggaatccaaaagcaggagagtggaaggggagggagagttgaaaagttacccattgggtacaatgttcaatatttgggtgatgggtacaccagaagcccagtcctcaccattacacatgtaatattcatgtaacaaacaagcatgtgtaaccccagatctaaaacttcaaaaaaaacctaaatattattgagcaacttctctgtttcaagttgaatcccaaaattcatatgttcaagtcccaactcccagtacctcagaaaggaaccatatttggagccaggacctttaaagaggtgagtaagttaaaatgaggctgttaggatgggtcctaatccaacctggccagtgcccttgtgagaagaggaaagttggacacacaaaaagaccccaggcatgtgcagatgcgcagaggaaagactgaagaggcagcaaaagcatgactacctgcaagctaagaagaaaggcctcaggagaaaccaaccctaccgacaccttgatcttggatttccagcctccaaactgtgagaaatacatttccattgtttaaaccaccccgtctaatgacaggcactgttctgaagaagttacatagattaactcaattcattctaacaacagcctctgtgtgtgtgtaaatggaacaagaggggcatcaacatccttctgcagacagggaaactaaagtccagagcagttagaaaatacaagttaaagaaaaattacatgctaaataaatgattgagctagaatttaaatgcccgttctctgtctgcctccagaggccatgctgaaccactacatgctcctgtttctgtatattgctggcatccttcactatgaattgctacatcactccgtttcttgcaatctttaaagaacaaagaaaaaaaaatttttttactcacttaaaaacatggaatatggtatctacaaataaataagcaagaaagccaatgcttctgtttcctcattttctttttaaattctctgaagatgagttcattagttaagattatttatcttgtaagagaaacccccaactcaaactggtctaaattaatttttttaagtggctacttctaaattaaattaaattttttaataagtggccactataaatcctctagcaggtaagatggctgctacatttccagccttcacatcttcacatcatgtgactcaggggtgagacctggtctttgggcctcatttctcagaaccctcagcaaaagtgcctttccattatttggctttcagtttcacattcatggctgagacaccatggccaagggtctggaatagagtaatttgtttaagacagttagattcccatccaaatcacagagctgagggtctcaggatggagatggaaggaacttcccaaagccttgttggaggttgccagaggctggtgggaggaggcatagggagggagttaccatttaatgggtactgttaaagtgaactaaatatggcctgagaaggactgtgtacttctatatttgagtccttgtggacaaacctaacctagcttaataggaagacaagattgaaaacctaacttaggagtatgcagcctgtaacaatagctgagtgttggccaattccagcagccatgcttcagccactcatagactgctgagtgttcaaactgtgttcaaataaggcaaatgccaacctgtaaccaatccagctatctctgtacctcacttccaatccttgtacatcgctttcctttttttgtctatatttttttctgaccacgaggcacccctggagtctttctgaatctgctgtgattctgggggctgcccgattcacgaacggttaattcttcttttcgctcaattaaattccatcaaatttaatttgtctgaagttttcttttaacagtacagagttctatttgggatgatgaaaaagctctggaaacatggtggtaacggttgtagaatattgtaaacgtgctgaatgccactcaattgtacactttaaaaaggttcagatggcaaattttatgttatgtttctcttacacgaaaaaaagaaaaaaagaaatgaaaaggaaaaggaaaaagaaaaaactctctcctaacatgtttcacttccacgtcggctgaggcctgttcatattttattcccaaagtgcccctttatcattgaaaatatcccttgagagccctccctgaccacagactcagtgctcgcttctacagagaaaattacaattacgccagagtgtgttgaaactaacttgtcactgggctcaggaaagaccatgttattcatgggagccaagaacccttatcttagacttccagagatttcttacagggaggtcaagtcacttattggtggttcaagtagaaaaaaatatagtgggctttttgagattaatatttcctggtggcatttttagtgttcattggaaaggaacaagttctagtcgggtaagctgacagacataaaaagggaaggagctgccgcacctagaggaggatttgttttctcctgggactgtgtatagataagcacacacccagaagcctgggcaaacccagagagcagcagggggattacctgctgacaagtacagcaagggtgagcagattgccctgtgataaaagccgctcaattgcatcatctctccagcaaggggaaaccagctctaaggcagccatctagttgcaaggtgagttcactgtaattgcatgttgtgagtagcggttgcttaaaaacaatgaatttatacccattactcccagcgtcaacttcagaatgattttcatcacgcctgcttttgtgcagctaagctgcaaaatgtgcgctgcgacagactgaagcagataaagaacaaatttgcatgttactgggttgcaagagccctttgattgttggagaggcccgataatgctgtcaagagctcggtggactgagcggcggccgagacgcaccagatctgcactaagtgtagctgacagcaaacgatttagagtcagcacggaatcaaagcgttggaaatatctcaagtaaaaatgttaaaaacacaaagaagcctgcatcttgataagaggacatcagtgaggagagatatgcacagaaagaaagaaaatgaccttgagtttataaaaatgctacacgtctcggaattgtaaaatgcctaaaatgaaaagaaaatgggcagctcaaatcagacttcaagctaggaaagcctgaaagttgtgtgcttgccacagttgaagaagagaaaaagaagcaatagctaactgcacggattattatagagattacgcttctgttttcgagaccagtcatttgctcgtacaaatgagcctaatgacttaaagcaccaagacatacatgtctctgctgtgcacacctccttgacatgaaatgcaagactcaaaatacaaaaataattttaggaaggaaaaactgattagtggcaatgatcaagacaaatcttgctatttgaaaaaacaaataaaaatactggaaatgaaaccttaagtagtattattaaataataatatcagggtggggcacggtggctcacgcctatatttccagcacttcgggaggtccaggcaagtggatcacctgaggtcgagagctggagaccagcctggccaacatggcaaaaccccatctctacttaaagtacaaaaattagcatggcatggtggtgtgcacctgtagtcccagctactcaggaggctgaggctggagaatcgctcgaactcaggaggtggagcctgcagtgagtcaagatctcgccgctgcactccagcctgggcaacagagtgagactccatctcaaaaaataataataataatttaaaataataatacatttgccgcattggaaaataggtcttcagcaaagtatgctatatagtgtatcagtagggagtaagctaatggttcttctccaggaaagactgcatcttctgtcagcatttgatgtgattcaaatcagactcttcagtttcttcacttatgtttttccctttcctttctctccataaaaacaatgactatcaccaggtctgtaatcttcttccagagagaaccaccagaaaagaagagcaggtagacatagctggaaaatcgaagccccaattttctgacaaacaaaactagccagaataagcaaataaattacatgtgcacgtgtttctctttagtctttacctgtgtatttccctagaggggaaaggtttataaaaactagaaagaggccatgttttctttatcacttgagtttatcaatcacctaacataaagccaccatgggctcccagttttgaaaagcgaattttccacactaaaggacatcttcagacactgctcaacccacacctgagttcaaatatttatatatagttttaatacattgatccaacatttgttttaaaaaacgttccccaaatttttcttgttgatgacggtttttaatagaaaaaataagtttccccagtttccagctgcaatgtgatcatataaataatatttaactaaattatattctgtgtgtgtttgccaagcctaaaagcatttttgcccagtggcctgaaatgttcctctaaacttttctggcttactggtaaacatttaacatttcaaaatagattaaacggggaatcgtgagagcctatgtaggaaactgtttctttctaaatattgtgctttgtctgttctgatttctgaattcatggcaaatcttccagcctttttttccactcggggtagaccatcaaccatggtagaggaaaatagctttaagaactttactacattgtgcaattttctaataaaacacaagagggcaggttttgctttattgtaagcctaattccactcccctggtaatcaagatcagtcactgggctaattgcaaattcagaaaccctcaataacatacaaagtgaaggagtaatcagggtgcataactctggcagtgaaatctgttgttttaataaagaaggccaagctcaagcatctctacttagcattatttacaaccagtacaattatacttgggaggcgctgtgatagttttagtttgttcataaaatgccaaaagagcagaaaatggctaacagaatgaccaaatccagtcatattagatttaagaagtctgactaaagttgatggggcaaataacaaaagtgggccaatggtttccatcaaacatgcagctgtggagaaaattatacagagcatgcaagtattgaataggaaccttttaactttgttttgttttagaaaactttaacttctagttcacaatactcttgtgtatggttttcaatatttcatttaatgacctgccaaagcagaattaagttcataagggtttttttcagcttgaactgctgttacggctaaagtcaaagtattgtcatctttggagagtttctaaagcaattgctgcttgagtccatcagtgtgagagaggcattggtttgcctgactaaataatttgcccactaactccttccactgaaacaaagcttttaggatatcagacagtggaggatcctaaaatggcatgtgtgaggacttagaggagagatgggtagaaatcttaacttcctatcctagtccctaaaaatggtagaattaaggcctaccaatagtaggaagaagatacatctagaaagaaaatacacctgaagagtatctccttgtgttaggttgcatagagtatgattctacctagcatacgtgcaattcaaaatctgaaggataggttgtatggtaacttcatggcagagatggatcttatgttttatccagtacatcttaaaacagatgtcagaagctctgaatgaaacattctactttgaaattagtttattcattcacttattcattcaaagaatatttataaaatactcaggataagtaaggcactatagaaataggaagagcttcaaccttagagtctccaacaaattgacccatcttgaaggcttatctgggagatcaccaagttagctactgcaggacctctcttccctggtcagtcacttgaagcagccacctgcttccaccccaggattagtcactaaactgtggggaatatcaaaagtaacttcacctgaggaaaggctggctctccttttcctacctgttcaaacagattcagaaaatagcaattgtttggaaactcaccagaaaatagcatatcagtttaagagattatttttcagactgaggttgttattatatattttacatgtatatatatttcaatatacatgctgagtgcccaaaagatgggaattgatgcacactacttaaaaaacaataatcctcaaaagacaaacaataatctgcaaaacaacatttatttttagtttcctttttagtaagttttctacttcttaataatgagattaaaactagtcattaaaagtattataattaacaatgttaaatcctaagcaagatacaaatgtcaattttagaattagaagggaatttaatgcacaaaggaaagatgttattgcattttatcccatttctgaatgttagctttataaaaagcatttctattaaaatcatacatgcagtttttctaatactgaagatataagcagtaaagtgatctggtcattttctccaaggttgaattcttccccctatcattgagaaatatagcccacagtatttggtgacattttctgagtttatttgcatgatattcaatgtaagtaaataccaactttttattctgttggtttatcctaccttaatatttgttaaaatgcattcataattgatttattgtaaggtcagaaaatgctagaaaattgtatttctcttatatgaactacaaaattaggaaattctctcaggaagacattataaaacataatagttataaaaagtcacccacactacagataaaagcagctaagtataatcgattactattttttcctacctaagatagatctgctttaaccaagtcttatgagactatgatatatgagaattctgatatacctgacagataagctagaggtggttatttgctttatgaaattattcgtaatagttcacttataaaaagtaacttctggcgcttttaacataattgatttatacataacttttcagaaatatatgtaccatgcacaattatatctccattttaataaatttctctttttgtttaaaaccaagatttaaaaatgtgttccccaactatcctgagctcagagcataaaccttccagagtggagcatgtgaaagacacagtgctgtattttccatgaatattgttaatggcaggaactgagaggtatccatgtggctgaggctaaaaagcccaagcagggctttaccgggctatcttgatcttcaccactgagcctgctctcagatgcacctgtagctttatgagattcaaattcagttccaactgggctttgtccatttctctggctttagcagtccttttgcatggggtaaactggttcttgatgagtcttgcaccctctaggaccccttatgttgaaggcagctccagggacctcttaacacccattctttacattcattcattccagtagagaggggcctcgacagacaagccacgccctagaacttcagtctcactcctgatgcacagaaaccagatatgagcagatgaaatttgcctggaaatctcaagagccattaacttctctgaagtggggtccatcatgataagtctgaacatcgtagtaaagattgtctcattcttattcctcatgatctgatgattgcatagcagaatataaccacttaattctgaattgtcatgttttgtacagatggtttgctttcaaatgataagacttaattgatcagcattcataagtaactgtgagtattcggcaacattaatcaatctaacatcaatgcttaaaaataagcccagtgcattatgtgggaataatttttcatctgaggctacctagtaaagaaattggtagaggatcagccaaagagacctcagagtaatgggactcaagtcaaattgtctcatgttcaggtttacagcctcaccagccttcagtcagccttccttggaaagagtaattctgtatttgttaataggtttacagtagcatatcaactaaccaggaaactctataattttattatcttctctatttatcactatagaatcaatgtgtatccagctattgaatcctgtaatataggtctactgtttaaaactgcagattttaagtaaaatccgtaaaatctagtttacacaatagagtggaattgatccttcatttagtcattttccatcctgtaaagaaaacaaggcttattctcatcttctaagctggagaggaaaaatatagagaaaagaagaaaaagaagcccaaggaagataatcaggagggtgcctagaagcagagatgtttatagctaaaagggatcttggagactcatctagcacctaccaactcccacctccatggcattaccaataaagacactggggctaagaaagattgatgtatggtcttggccaggtctcacattgcactgacctgcaaatttaaatgactcccctggatcaatgttttgggattttttttgtttttttttaaatgctttcagaaaaggaggaggcttaatcaatattggggggggggttattattagatatcacaaattgtcaggtctatctttatttgaaggtagaggtagcctcaagcactttagttgggtttgttaaacaagcaagcaaagcggaaactacagctaagcatcttctgaatgagatcatcatcactatagaagaacctatgtcaaagatcttcaactcaagaaggaacagtgaggattagttcctttattgtcagcgtcagaactgtggcttggccagcctcttctcttaggtaaggcatgagcaccctaggcttcttctgtgtatctcttgctgcttaaatgtgtctccattaggggtgtatatccttttcgaagtcttctatattgaagaaaagccaacagcacaaaaagaccaaccaaagccaccagtgttcccatgactactaagagagttgtgggccaacctggagtttcttcaactgaaactaaagcagaagagaagggtctacaatcaggattttcatcagctgaatactttcagaagagaaaaagagcaagcgcacttgcctttcacgtgctttttgttgataaagcaaaactactcatgctagactaaaatttatcttctcctttctcaccatttatcatatccacaattgtttttcttggggtagtcagaactggcatcccattacttaaatacagcttattgcattttaaaaatttgttacaataaatgcttatgccgaagaaaccttctaaggaagaatgtaactacttttctgagttagaaactcatttgtgaaagtgcatgctaaaatggcatctggggagctgcaaaatatacagcccttgggaagagaaattctgctattgtctctaccttttttatagaatgataaacctgtgagagggatcagactggctattacaccaggagacactcaataaccaagcagatgatatttatacccattcaaatagttgtgaataaaatgtaaatctcccacatgataaatccaatcttctactctcatatattttataagctctcttccacaaaattagtggatttcattttttggtttttttttttttttttttttttagataaagtctcgctctgtcgcccaggctggagtacagtggcatgatctcggctcactgcaacctctgcctcctgagttcaagcgattctcctgcctcagcctcccgagtagctgggattacaggcacccatcaccatgctcagataaattttgtatttttagtagagacagggtttcgccatgttggccaggctggtctgaaactcctgactgcagggaatccacctgcctcggcctcccaaagtgctgggattacaggtgtgagctactgcacctggccgaatttcatttttaatatacatatgcctatttttcatttattttaaaaattatattctccttggccaactgttcttaaattcagctcctctgaatttgttctataccttacactcacctaatataagattctctttctagtcctttttctgcaatcccatgggaggtcctgacctgtcctgatgggattcctccaagagggttttgatctgtctcctcctgattcaacccagcagcacctattgccaacttcatcttcttaaaacacatatatttttattctgccatttctttgttcaagaccaaaaaatggttgccttttgcttttgtccaaatcctcttagttttttaaaaaattatgttttagaaattgttgtaacatatatgtaacataaatttgaccaccttgaccatttttaaataggcagtgcagtggcattaagtacattcacattgttgtgcgaccatcgccaccatccattctcagaacctttatatcttgcaaaactgatacattgtgcccaccaaacagtaactccctattctcccctcccaacccctggtaaccaggggtctctatgaatttgactatctcatagtctaagtggagtcatgcagtatttgttcttatgtctggcttattaaacttagcttagtgtcctcaaagttcatccatgttgtggcatgtatcagaatctccttcctttttgaggctgaataatattccactgtatgtatgtaccacattttgtttattcattcatccactaacagacacttggtttgcatctaccttttggctattgtaagtaatgctgctatgaacatgggtgtgcaaatatctctgctggaccttgctttcagttcttttaggtataccagaagtataattgctgggtcatatggtaattatttgttccatttttttgaggaatccccatactgttttccatagtggctgcaccattttacattcccaccagcaatgcacaaggattccaatttctctacaccctcagcaacacttactattttctatttttttttgatagcagtcatcccaatgggtatgaggtggtatcttattggggtttctgcctggcatctaaggccctctgtacctaggctctttcataaatttgaacttaattcgaggtaattctctgcccaagcgtcccactacagccaggcttgaaagactcaggtcaaagagagagagactgagctctgaaatcatcttgattgctttctaggctgagactttgggtaaataggctgtgtgatttttcaccttcttgattaagattttttaaattgttttgtttttgtttttttgggtttttttgaaacagggtctcactctgttgcccagactggagtgcagtggcacaaacagggctcactgtagcctctacatcctgggctcaagcgattcttccacctcagcctcccgagtggctgagactacaggcatgcaccactatgcccagctaatattatttgaattttagcagagataggtctcagtatgttgccaggctcctaacattctttaaatggtgtgtggagccatattggggcctgggccaaaaagaaaaacatgtgccctgtatatacttgtcaaaatatcctcccatatgttgaaccaagtgggaaaagttaataagaaatctacaatcttaaaacatgactttaaaaacagtaactaatgcaacatacacatagagtcccacgtagcccaatctgttggtagaccaatcaatgtcagccttcatgaacctatccatcgcaggtggtataggctaaatgggaaatgactgattcagttataagacgatgtgggtatgaaaaacaaacaaaagtctgcctttatttaaaattttgatgatgtattattcatggttaattttttgcattaattttgactttccaaaattttgtattatattattacttaccttgattactgagttttctggcctcctcttgaattttgtgctcaaggcaaatgttgtactttcctcaccctaatcccagccctgccctcaaggaataatctctaaatccagctagtccctgtacagtgtggctagttcatttttatttcattggttagaaatttcaaagaaccatagggaggttttttattaatccaataaactcagagagaattgtcaagtcaggtgtaaaagcagatagttcatttaataagatctatttaaaactttcagttttctaaaacaagagtcagctcattagtccctttctgatgtttaattggtagtttaaaggctcattttgctaaatacgtatatgctagaaaaatggtcaataaacttaactagacctgaaagcttcggctaaaggtcttggtttacattataaagaaagaaagcaagaaagctagcttctttagaagatgaatgaatcacccatttggaagttgtgttagttacctggcagatcgatggcatagctgtagccaagttggtctgaggttaaaaagagttcttcattagtcactggagggaagaaaggaaccatgttgtacatccgattgtgaccaataggggccagctcctgaggccaggcatctgcaggaggattaaatcttttcatccactcatcaaagatggcatcagtaaaggaatgaagaacctgcaaaacagttggacacagcatttaacataaatcagtctgttccgatcacaccaacctgactgttgctttctctaaagtggaataacttcttcttgacataggaacttctgtatacccatgtgtggaatacccccttctgtgtaccaccatgaggaagcccaaatcaactcatatagagtgactatgatggcgaggatcaagatttcgggaagaaaaacagttaagttttcaacgatgtatgaatctctctctccaagcaggactataaacccctttgtcaagtgagcaaatgaaagttcatgttggatttaacattggttgcagattgaacatttgaggccttcaacatatatgtgttaattatgaaattcagaaaaaggcaagtatgataagatacatgttctagtattgagatgatttggtttaacaggagagaaagaaaaagttgtgtttacaggttgagtatctgaaatctgaaaatttaaaacctaaaatccccctaaacctgaaacttcttgagtgccaacatgacacttgaaggaaatgctcattggagcatttttgaattttttggatttgggattctcaactggtataatgcaagtattccgaaatctgaaaaaattcaaaatcccaaacacttctggtcccaagcatttcagataagtgatactcaatctgtatcaatattataatataaaggaacagtaaatttttctcaccaggaatactcttctgtctactcatttcataaactctcacttgaattcttgctgttatgccagcaaaagaaagtctaaaaaggtaatgtacaaagtgctcatttatgttttctcaaggaagccattaaagtccttttaaaatatagcaattactatatgttttgaaatattaacagcaaaatttccacattgatagccctgattttgtaacatgatacaagtttgagagttcagtcccaccttgatggcagttgttggagttccttgttccttcctggatggtaagttcaaggagctcaggggcagtgtccttttttcattccccctggatccccagagcttgtcaccccagggtgtctcatatggagaaagggaggtacttatttcagtaaatacttattcagtgtattcattcctccattcaccactgtaccttgtacctcatttatagcactgatcaaatgatactataacttgttatttatgtatctatgtcccctaacaagatcctaactccttaaggtctaagataaggacttttcacctttgaagtctcaggtttagtatacaacctggacagagtcaatgtttactaactatgtgtttgctgatgacagtgtcatgcagacactttgcatacagtgcaaagcttagcatacaacctggacagagtcaatatttactaagtatgtgttggctgatgacagtgtcatgcatctttatttacataaacagtttgtgcaaataaacagtgtctagggatatacaaaaatatattttccaaagaaggccacacaatgtttgtttcttgactaacatgcttttctagaatcttgccactccctcattgaaggttggcttcatctggccttcccttgaaacttggtgagtttctgactcttttataaccaataaaatgcaacagaagtgacattttgtgactttcaaggttaaatcataaagtgtattgcagttcctatcttgtgcctgagccctgaaccatcaaataagcagtccagctgtcctgaggcagccatgctgtgaagaagcccaaaccaactcatatagagtgaccatgatggcgaggctcaagatttcaggaagaaaaacagatagcgggccagtccacagctgttccaacacctatcaccatctgactgcagctgcactgaaagatgctaggctagaactgcctagtcaagcccttccaaaattcctgacccacagaaatggtaagaaatgaaatggtcaccttcaagccactgagtgtttgggtaatcgtaatctgttatgcagaaatggataaacacaacaaaggaaaaaaacctgagtagagcctcccaggctcatggttaccagcacatgcagggaagggagttccttggtcgctttctcttttctgttgagacacaaaatttaatagaaattttgtttgtagttcttacattctcagtgtgagctgaattgggacccgctgccccatgcagaagtggcccattcctggaggcaggggagaaactgtgggggggcggggtgaaatgggaagagccccattcttcctcagtgttggggggctagagatgccacccccttttcctggccccctctgggttccaggaaggagaacagatggaatgtcaggcctgagacttctcctccacactgctgccccctgggtgggagggtagctaagagatccagacagagaatgagaaggcagaggtggtgaaacggggatagtgacgcagcttgagatgaataaaacacagcctgtggagctgatgatccaggatcacagaggtctgtaaacctcaacagtggacaccaataacatggcactgagaaggtagggaagataatatatattaggtacctagtacacagcacctttcttgtaggaaatggttattcaatggttgttatcactatgactataccatcagtactattattattttaacttgggacaaggacttatggaagaagaatgatggaattcgcattttgcaggtgggtggggcctgcaagcacctctgaaatcacacacactgtacatatagccaatgaggagctgggcatttaggaatgcatgtggcacatgcctagcactttttgataagtaaattagtgagtatttattagtgtttgctcaattacccaaaatgacatattgaatcctcaaagcagcctgatttggtggatattatttgtttgctcaggctgctgtaacaaagtactacagactgggtggcttagacaacaggcatttgtcttacggttggagacagtgtctcgcttctaggcagctggaagtccaacaccaagatgtcagtggggctggttccttctaagcactgtgagggaaaatctgttccagacctcactcctaccttctcgggccttgctgacaatctttggcattccttgccttgtagatctctatcttcatcctcatgcagtgttctccctgtgtgcaggtgcctatgtccaaattttccctttttatagggacaccactcacactagattagggacctactctactccagtatgacattttatgttaataaactatatctgcagctatcctatttccaaacaaggtgacattctgagttattagctattaggactttgacatatgaattttgtgggggacaattcaacccataacattattaccctgttttacagatggggaataaaaggcacaaaagtgttaagtgacttgcctaaggtcacacagctaatatatggtagagtaagaatttgaacccaggaagtctggttctaaagtgagagttcctaatccacatactctacttcctctacaccaccggtccccaacctttttggcaccagggactggttttcgaggaagacaattttcacggaccagggggtggtggatgggaagggagatggtttcaggatgaaattgttccaccttggattatcagacattagttagattctcataaggagtgtgcaacctagggccctctcaggtgcagttcatgatagggtttgcactcttatgagaatctaatgctgctgatctgacaggaggcggagctcaagtgataatgctcaattgcttaccatccacctgctgtgtggcccagttcctaagaggccacagaccagcatgggcccatggcccaggggttggggacccctgctttacaccaccacactgtagtacaaccttcaggaccaactagaataagaaaaattgattttgaaggcatattctccaatcttaacaatgcagaaagaggatactttgacctatgagtcctaaaccaatcatgaacttttagatactgtctgagttcaagtcagggttcaaattgtgatgacagaaagagacaagagactatcaggacacaaggaagatgcagaatcagtgctgtaagaggcaaataacttatagaaagtatcagaattcaccaagggaaaaatgtaaataataaaggagaaggcaagatcctaaggcaattagtaatctggagagataaaagaataggggaaaataataaggaggaattgaaattgtagctctcaggagggctataaaacatacaataaatgctctagtaaggctgcacacagtggctcatgcctgtaatcccagcactttgggaagctgaggcaagaggatcacatgagcccaggagttcgagaccagccccagcaacagagtgagaccccatttctacaaaaatttaaaaattagctaggtgtgatagtgtgtgcctgtggtcccagctacttgaggctgagatgcgaggatcatttgagccctggaagtcaaggctgcagtgagctatgattgtgccactgcactccagcctgagtgacagagcgagatactgtctcaacaacaacaacaacaacaacaacaaagctctagtaagaactatatacagagtacccaaattatagaatgtaagtttttttgaaaagactggtacatgctgagaaaatgcaaagcatccaatgaacaaaatgctacaagcaataacatatctacaagctaaaaagagaagtagtacaatctacggaataggtagttttgttaaaattgtgggcattattcctcaataaggtaccttgaattgctcttgaaaaactaattgtatctttgttaaatacaagttaaaaatgttaaatacaagttaatatctctgtaaagggtcaaatgtcatttgagggtaggaaacaaaagcaaaagttaaatgaaagtgtatcattgggctgggcatggtggcccacacctgtaatcccagcactttgtgagactgaggtgggaggatcacccgaggtcaggagttcgagaccagcctagccaatatggtgaaaccccatctctactaaaaatacaaaacattagctgggtgtggtggcgtgcacctgtgatcccagctattcgggaggctgaggcaggagagtcacttgaactcgggaggtggaggctgcaatgagccaagaacgcaccactgcactccagcctggaccacagagtgagactccatctcaaaaaaaaaataataataataaataaataaatttgtatcattggtgcctttcatctgctcgagggctacatagctacgttttggtattagaaactgagtacttcagaaatgaggttccgaattttggcatataaacctattctgtcttgttccaacaaaatgaggataggtacagaaaaggaaaaaaaaaacaacactaaatttcaaagtagaggccataatggaaaaaaaaatgtgattacatgggctttcaaggtaaagatttttcatgtaacccatgcaggagaaagtaatcaaccaacaaatattgcacctgcaggcataaagaaaataaaatacaagaaagtgtgcattattttttcaagatcattggaggataaagttactatcaaagggccttagcttaaatgactataaatttggattcccaccacacagatgaaataagaaaagtttctgcatctagagaaagaaccatggaaatatgaggccggctgcaaagatgtgtgtgcatcattaaagaccagcacagtgtagctttcaccacttgagttcatgtgttactgcccagaaggcatcctttgtcatcagactggatcctattgtggtgacatgctattgctctggtcctctgagagtcagaactaagtgacaattcaaatgtgatcacttaaaagccacatgacagataaaagcacacacaggtccatatgggaactctaatttaaaacttaaagtagaaggtatacattaaaaggttggtttggactttttaaatgagagaattcctaatggtcattcctaaaaaatatatttcatcaggcttgctattttagggaaatatcttgtcttgttctaccaaagatttgaaaacaaatgtaattgggatgctggtttcacactgccctaaataggccatatgtaataggcatgaaatagttaaacaacacccaagcctttatttaattaactaagctctgccacaaggaggtgggtactacacagagagaatatttcagtgactgatgagaaacaatctcctatggactcaatgtgtgtgccctaccccgaacaaattcatattttgaaatcctaactcccagtgtgatggtaataggaaatggggcctttgggaaataattaagccataaggatggggttctcatgaatggaattagtgcccttaccaaagagacccagagagctcctccctttcagctacgtgaggacaagcaagaaaatggccgttatgagccaggaagaagttcctcaccacacgctgaatctgctaatgccttgatcttcaacttctcagcctccagaactgtgagaaataaatgttgtttaggccacccagtctctggtatttttgttttagcagcctgaatggactaggacacaaccacggaagagaaaaaaaaagatattggagcaataatagcatcttccaggcagggcgcagcaaggatggtgctataattttctctccctatatttccctatccattcttttatagcaccctgggcaggcaaaacagagagtatttctcaggcattttggaggagttatatcaggaacacattctcccacatagacttgtataatagccttgtatactatatgtgtgtaaaaatgtacacaatatacattgtatacaagctctaacagcacacatacaaaaaaaaatcgagagaattagaaatgctgattctaaacccttgaggaaaaaaagcttcttcttcaagaattaaactctgaacagatgcagaggactacagaaagactctgctaggtcaactttaaaagaagtgaccagttcaacatgcatcataagttgacattacggattggagaaagaaccaaggtgatgctagaagagattctagacagagactaagctacctctcaggccattcttgactaaacaatcatgaaaactctaggagagagttgctcaactcaatgctagaaccatcttagatttgtatgtaagttgtggtttgttattatattcatattttatcagaatgaattggatgtaattcataggtttagttcttctcaatatagtatgcatttatccttataaattctagagttgaagagaatccattcaggtgacatttagcacctgtgaaattaaagaaaacaagccagcccccagcctagtccatagaaacactgccaccctggggaaccagagaggggtccagccaccctctctgattcctcagctcttataaaactcatcaagatgttatgccacttaggaggtagtaactgtgtacctgctatttaaaaactagtattgaataagtaaatgtgacatttaaaaagcataaatacatgctcacaatgaaagcaatgactatcatttcaaaagctgtgcaaaattagtcagatctgcccttcaccaattagtgttaattcctattaatatgatctaacgggacttaatttcctcagctatagtgaatgcaattgtgaagagactgagttaagaattgtctaaactgacaaaaggcaaaattgtagttgaaagattgaacacggggagatttttgaataggaaacttttcttataaatctctgctcagccatttactgattggtgtgaccttgacacatttcttagcctctctaaactgtattttccctgtgtttaaaacaaggagagtagtttactatatacagatttgttcatttaagaggtgagctttgcaagacatctcgcataggggccatcacagaatagatgtacaataataggacattctcctcacaaaaatgtacagaacatctactaagtgtcaggtactgttctagaggttgagtatgttttcagtgatcacattcattttccataaactaataaaacctacaaaatacatctttacatgaccagattattaggttttccaggaaaataaaatattaaaagaaaatgttgtattttgttactcacacagaggacgaattactttccctaattctgacttttttgaatatttagggttttttttttctttttccagaagtcatgatcacaaacaaaagttatgaagacagatcacagaaaaggaggtgcaaatggattttttctttttgaatgtctgaaaagatgctggacttcacttttttttttgagacagagtttcgctcttgtcacccaggctggagtgcgatggcacgatcttggctcactgcaacctccacctcccgggttcaagtgattctcctgcctcagcctcccaagcagctgagactacaggtgcctaacaccacacccggctaatttttgtatttttagtagagacaaggtttcaccatgttggccaggctggtcttgaactcctgacctcaggtaacccacccacctcagcctcccaaagtgctgggattacaggcgtgagccactgcatctggcctagacttcacttataagaagagaaatgcaaattaaaatttgctaaaatgccttttcacctatcacgttgacaaagatgaaaaagtgtgatgacacagggacaaagagcataatgagagggaatgatgggggaactgtggctctgacacataggtgacacacaggtattaggagggaatattgtccaaacttctagaggcaattctgtaacatttatcaaatttcaaatgcatttttttaccctttaagccagggattctattctctttacttaccttacatgttcaaggatgtttgttgtagcattgtaaagcaaacgattagaaatcacctaaatgtccatcaacagaaaatagtttaaaatcttaaatttaaaattaaaataatacatttcaggataaatccatgcaaaagaatactatacagctataaaaaaagaataagaatgcccttcagaactgaaatgatttggaataagttaaaaaaaaagtgggggaaaggcaaagggacagaggggtctataatatgctaccatgtagataaatatataaacatatttgtttgtgtatttataaaatatatctggaaaattagaaaaaaattgtattgtttgctggaagatggtagtgataatacggacttcattttatacattttatattttgaatcttttatgtgcactaagattttaagatgaaaaaatttagaaaactatgcaacaacctaaaaattaaataaattaagtgataatgggatattatacataataggtgccttatagagatggtcctctgaatccaattataagtaatctagacatgatttagagtatacagaaggatgtgcgtaccttatatgcaaatataatgccattttatataagggacttgagtagtcacagattttggtacccatggtggggggtcctggaactaattccctcaagatattgagggatgactataattgcaactgtataaaacatatgagaatatgaaaagaaataaacaaaaaaattgagatggaattacaggcatttaaaaactattttcaccaacatttctgtaattataaataatataaaaatcataaaccaataaaaataaaaatttcacatacaacaatgttattttatttttttacaatattagtctaattatgatttttcttatttaaagtaaagcaaaatggatctatctttaaatgtttcactcttgggaagaaaaaagcaatgccctattgatatggtttagctgtgttcccacccaaatctcatcttgaattgtagctcccacagttcccacatgttgtggaagggatgtaattgaatcatgggggtgggtctttcccatgctgttcttatgatagtgaataagtctcatgagatctgatggttttataaatgagagttttcctgcacaagttctctcttggctgccaccatgtaagatgtgcttttcaccttccaccatgatcgtgaggtctccccagccacatagaactgtaagtccattaaacctctttttctctataaattactcagtctcagatacatctttatcagcagcatgaaaacagactgatacacctatccttctttttttaaatttcaactaaactcactctaactcagaattatttatacctgtaattgtgagcttttgatttcactaactttgttgtagcctagaacagcagactcagaagggctctttcttacagggttaatttatggtagtccatcagctatgtgtggttttagaaattcattttctcctgctgcacattttctaaattaatgaacttattttatacactgattagtaataagactactgtatgttgtattccatttagaatgtcaacgtacaaggtagaaaacaggcacgagctgtttagtattaattatggaacctatggaccccccagccactgatgaattgaaggaacgtagaactcaccaaatgtactttctaaaaggataacatccaagtatactcttaagaatagtatctttaggaattgggaaggaaattaccactatgtaacacagtttctttcttggcatttaaataactttacagtctgttggtttccttttttttctcttttctggattatatctaaatttaatattgaagacagcacttagcatttctctggcctaatcttattttccatgataaatgtgtgcatttgcctcaattaccttaggaattactagagattgcttcagagtttttcctgcactttaatgttctgccttcttttgctcattattgtgatcacatacaattttgtagctctattgcttggagagatttcacaaaaaaaattttaataaatgtcatgtgcaatatatttgcatgaattgcctcatgaatttgaaattccagaagctataactctgttaactgaaatactttaacctggatctcaatatgtgaaaaatcatttaaggctgaattggcttcagcataaaactctttgaaaatagcctaaagtaatggtgagttctggaactaggcccaaaacattattcattctgtgcctttaaagaaacgctgtggctttttgtttatttatatgtatattacacatactactaaagaaaaataaaattttaacattaagcacattagaaacaacgaacacaaagatgattaaatgtcttatatctctgaaccacgggatttctcacccatcaagtcacaatgtgagcttccaccctaaagcagaaggagaaatatgactaaagggaaatccctactacaggccagatatggtgactcacccagtgctttgggaggccaaggtgggaggattgcttgaggctaggagttctgagaccagcctaggcaacatagtaagacctcatctctacaaaaataaaaaatttaaaaagctgagcatggtggtatgtggctatagtcctagctacttgggaggctgaggcaggaggatcacttgagcccagaagtttgaggctgccgtgagctatgattatgccactgcatttcagcctgggcaacagagagagactgtctcttagagagagagagagagagagagagagagagattcctactatccttactacaaactaatacaaagaagaaaagtgaatcctttacaccacaggttgataaattaaagcctgagggccaaatagagcctacaacctgtttttgtaaataacgttttattggaacaccacattcatttgtttatgcatgatctatggctgatttcatgatacaggggcagagttcagtagttacaacagaaaacatctggcctccaaagcccagaatatttgctacctggctatttacagaaaaatgttgccaatttctgtccacttagcaggcttgttcaaaagaaggagatacggtttagcaatcctggagacttgggatgcagaaaatcaaattactagcatcatttttaataggagagaaagagttggggtataatccttaatttatcagaggattccactgttctacttataacatattggagtactggataaggagtattatgacatttttccttatgaatatgaattgtgtgtataaattgtacagttgacaatgtatgctttaataaatacttagagacgtatagtataaatagatgtacagatacatggctgagaaagcagacaccagaaatgcttggcataagctatggctgagacgatagccagaaaaaatgatgtgaactatcaagttaaaatcattgaacaaagcaggcattctagagaaaagcaaagatcgctgtggcggcgtcacagataagcccccaccttgttagaggctgggaccattaattcagacttctgacaaccccttcatttattgctactatgcaaatatgaggaaagaaacattttttagaaggaaagaacaactctaccaactaattccgtctcaggatttcttgaagctcacctgactatgctttaatctatctaggagccccagaaagctacttcacacccatcaggcaagcttagaatcattgaaagctatacctttactctccctcttcatagctcctttttttgtaccctgggttgagtaacaataataaatcacctgtgaaatacttctgactttgtgcttattagtaaaatgtcttagggcattactgtctgctttggagaacaagataagaaatattaattaaggtttgaaaatctaaacctaacatatggttctctaattctgaccattataaaacacattattattgttatgataacatttgtattgtacttgacgggctctagaccagtttcctattgtcctaatctactaagagtcacttcactgagaacaacattttcaccaccagatcaggtcaagagacccacactttgcagagtgggaagcagaagctccatgtggttcaattacattcccaagattgccctggtctgtatcaagtaaaactgattgacttgtaatcagtcatgaagcctccaaaaagtccagaaaaacaaacttctggctgggtgcattggctcacgcctataatctcagcactttgagaggccgaggcccgaggatcacttgaggtcatgagttcaagaccagcctggccaacatggcaaaaccttgtctctactcaaaatacaaacattagccaggcgcagtggcacgtgcctgtaatcccagctactcgggaggctgaggcaggagaatcacttgaacgcaggaggcggaggttgcagtgggtcaaaattgcaccactgcatttcagcctggatgacagagagagactccgtctcaaaaagaaaaaagaaaagaaaaacaaacttctataaactgatggtttgacaatgcattataaatgctatatctggactgaactgtgtttccccaaaatctgtgtgttgaagccctaacccacaatgtgactatacttggagatagagcctagaaagaggtaattaaggtttaatgaggtcagaaccatagggccctggattagtgttatcataaaaggaggcatcagagagtttattctctctctccctccactatatgaggatgcagctagaaggctcaggaagagagtcttcaccaggaaccaaatcagctggcaccttggtcttagacctcctggcctctagaactgtgggatataaatttctgttgtttaagccatccaatctgtggtctttcattatggcagcctgagcagactaagacacattgctaagattaacattaaggtgaggaaaattctggagaaaaacagagagtctttggatatcacacaatctaactggataacaatataaactcaaaatactggcaaaataaaaaaggagaagaggtgaaatttcttcttgtaattgctccaaaactatctattcaagacatacaactcagaagacacacagacagggttaaaatagacgagggtgagttgcgtatctgtaaagcaggagcacttttggggattggctgctgagacatgaatgtgtatgttgtctaaatctcttatgacaacttgagtgacctgtacttagaaaagcagcccctgacattcaagagctggcctggcgctatcaacgaggacttgatgtccccctatcagacataaacgatttcgtagaacatcgacagcagacaaggccactctgtgaccatgacggatcaggacaaaaacaagaaaaccccataaccgtgtctgagcacagacaaattatgaacattgtccaagatgcaagatgcgtgacaccccctttcccggctaatatgagcatctgctgctgttttaccaattatggctttaacctcagtctagtctgccccatatacagacataatcactctatcaagatacccactcatagaatcaggaagcatacccctgcttcctgacaacatctgattcagagcaaagcttccaaaagtcctccccaaatcacctagcacaagcccaaaccctttctgtcttttccaacacccactggctgagactttccacagtcctccattctctgcctgcaaggagtaacagaccaatgtattcaactacattgtgttcctagaggtcacagactgaagagcattgactagggtagctgaacagtgtagccctgactcgtatttccccattttgtttgtcttagaaaagttcaccaggggatgaatatactttaaaaactaaagactgggcccagtggttcacgcctgtaatcccaggactttgggaggctgaggtgggcagatcaggaggtcaggtgtttgagaccagtctggccaatatggtgaaaccttgtctctagtaaaaatataaaaattaaccgggcgtggtggcgtgcaactgtagtcccagctacttgggaggctgaggcagaagaatcacttgaacccaggaggcagaggttgcagtgagcccagatagcaccactgcactccagcctgggcagtggagcaagactctgtctccaaaaacaaacaaataaacaaacactaaaaaagctcagaattgtaaaatttagaatcctattgtcaagttttgttcagtttgtttttgtttttgaaacagggtctcaccctgttgcacaggctgggatgcagtggcacgatcatggctcactgcagcctcgacctcccaggctcaagtgatcctcccaccacagcctcccaagtagctggaaccacaggtgcatgctaccatgcccagctaatttgtaaaggtttttggtagagaaaaggtctcataatgttgcccaggctggtcttgaactcctaggcacaagtgatcctcccacctcagcctcccaaagtgctgagattacagtcatgagccaccatgcctggcagttttcttcttttgttttaaagtgagacagaaatcaaactgatataccaaaggagttcatcacactgaaatttaaataactgtgaggctcctgcacagtcaacagcaatcctatttactgtctgtattattacatgtcagaggtatgaatcagattaacaaattaaattgcctcaaatgtgagtttttgtattaatgccatcggtgaaggcatttgtcattttttgctcctattagccaggaaaggggatgtcatgcatcttgtggcttggaaaatgttcataatttgtctgtgcttagacacagttatggagtagtcttgtttttgtcctgatccaccatgatcagagtggccttgtctgctgttgatgttctaggagattgtttatgtccaacaggggacaccaaggcctggttgatttcaccaggccagctcttggatgtcaggtgctgcttttcttctttctcaagtaaagctcactcaagttggagtaggaggtttaagtgtccagcacaccctctccattctcctccccttttctggctaacagaacctctctttcctgcaggtaacacattgaaggtggtttgtgtggactactgaacctcaacaatactcacttagccaatgaaaaatcatttattattatgctaatttatgaattcaccagtggaattgtaaactcttgtctaagatcacccaaaagtgaaccatccctgaagcatgggttctgattagggccttcaaatgctacctaaccatccctatggtatagattgaaattaatttacatttgcacacatcacattgttcacacagagaataaaacaccatcaaacattaattgtatgaaaaaataaatctgacatattatctagaaaattttcatgcattctgaatctttgaacataccacaaaaatgggatcattggcggctgaatgtggcaaagcgtttgtcccgttcaggaaggaatgaaccaaattatgaaggctcatcacttgagaatccagagtcccatctgctttatcaaacccttccaaagcattcctaggagaaacaagtatatcagtgacaacagacaaagactgataaaggtctcttttttgttgttttcagcctagataatagttgtctaatttgagattgggtagggatatgggaagctctgtcatagcaaattgaccaagaatttgccccaaactttaatgataatcctctgtaaggggagagaactcctaagcaacgctatttctgaattatatctcttttgtgtactgtatgacaactttcatatctgtctctcattcccttggagagcaggctctatgttttcttcagatatttattgccagggttcagtaccatgcccagcagattgtctgtgatcagtaaattcttttatttaacatataatctgatatttatatttctcaaccaaatagaccttcagcttgactgaaggtccagctactcaggaggctgaggtaggaggatcacttgagcccaggagtttgaggttacaattagccatgattgtgccactgcactctaccctaggtgacacagtgagatcctggctctaaaaaaaagaaaaaagaaaaaaattttctaccaccatagaaagactttaagaattatgagaaatatgtttataaataagactttaaacaaagatgggtccaaaaaggggatggtagatagattaaagatcttctccaaaactggattctctctctctcttaactgtgtttaaagtagacaatttgtatgggcccagggcagggcaggctggactcaaatgtagaggttgtgctaagtgtagcatggctcagtctgctgaggttggacacagccttcagagtagtgtcaaaggtgggggaagggtaacatttaaggttgttttgaaaaggaggatgaattagtttttcattgtgacaaaagtgctattaaaacagattgcattttctatatgtttgagttaggggagttgttctcaaaatgcagtgctcagaccaccttaactggcatcatttgggatttggttagaaatgcaagttgttaagacacagcctacacctactgaaccagaaactctgggagcagggcatgaaacatgtgtttttctttggtgattttgagatgtgcttaaattctaggcctacctctacaggtacataccaccacacctggctacttttttatatttttttgtagagacagggtcttgctctgttgcccaggtggtctcaaactcctggactcaagcagtcctcccgcactggcctcccaaagcactaggattacaggcatgaacaccatgcccaacctgtggtggaagattaatagttggtctttaaatgttaagtattgtaatgtcattgctgtgctatgatttgagttgaatttagtctgcaatactcctctgagatctcagacctcactattaagttctatggctgataaatttctaatatcgacattttaaaaaataagaaaggaaagagaaagagcatggacattgaaaaaacactatatttaatgaagtaccctgtttccaaagactggacctattaatgtactgcaattagaaatacaaaagttggttttgaacagctaagttagaaggtattaaaaccacattgttagtcatagtagatgggtaaagactttcctcacaccaatcccttgctaacttctctcgttaggcctctctccatcacttagcttcgtagacaacccccaaaacctgggtttccttccagttctttacaatcacaggcatgaaaacctgtactgtacaggcaggtccagcagagctcagagcacccacctgaaactgaaggtagagttctggaagaagggaggattgtcaaacttctggagagacaggcaatctcgtatgtcttttaaggttggcaatttcatgctgtttcttcccatttgatttcttctcagcaaaccttcataggttccattgcacaaggtgaccaggtggttgtagtcatccaagctaagatttgtaataagatttaaaataatatatgttggctgggcacagtggctcacgtctgtaatcccagcactttgggaggttgaggcaggtggatcccttgaggccaggagtttgagaccagctatggcaaagccccggctctactaaaaatacaaaaattagctaggcttggtggtgtgtgcctgttgtcccagctactcaggaggctaaggcaggagaatcgcttgaacccaggagacagaggctgcagtgagcagagatcatgccactgccctccagccttagtgacagagtgagaccctgtctcaagaaaaaaaaaaaatcccccaaaacaaaaaatgatatgtcttaacttatgtacagtattataaatttgggccaagcaaatcaatcagggtcacaatcatggtaaaattgtattacaattactttaccagagttaacaatatgtggtaaaaagtactatacctgaaagtcattatgggtcgagaagtttcaaaaatgtagatgcacaaaatacggacatgggcataaatatgaataatcattaccattctgttggaaagacagtgagagggtttacaaggcaagatgactcctattgtgtgcatttgaatcttgagtaactgaagggagaatagggtggttcgtattatgctgagctaagccagttttggcagaagtgacatgtaaagttacgaaaaccttttaggcaaactgaaggcaaacggggaggtcagagtaaaagcagatgaaagtacacaaaggggagatattagaagaaacactgtgttggaaaatgttccaaggtagtagagtatcaatagttaagtgctcagcatgggctgagaaggtcccatgtccgtaagacattatatcctacacgcctgctatggcctggattccaacatcagaatagtatttctttctttctttttatttagtttttcttttttaatttagagatagggtctcactctgttgtacaggctagagtgcagtggcatgatcacagctgactgcagccttgaactcctgggctcaagcaatcctcctgcctcagtctccccagtagctgggactactggctaactttttttttttttttttttgagacagagtctcactctgtagcccaggctggagtacaatggcacactgcaacctccacctcctgagttcaagcaattctcctacctcagcctcctgagtagctgggactacaggcacatgccaccaagcccagctaacttttgtatttttagtagagacagagctgtcaggctggttggtcaccatgttggtcaggctggtctcgaactcctgacctcaggtgatccacctgtctcggcctcccaaagtgctgagattacaggcgtgagccaccgtgcccagctaggctaacttttcaaactttttgtagagacagggtttcactatgttactcaggctggtctcgaagtcctggcctcaagtgatccccctgccttggtctcccaaagtgcagaccattatttcactggcagagataaaaatttaaagatgttattgtgagggttttcatgaattagggataggacccagtatgtgagaatataatcagcacatccacagggatgaaagaggccaggacctaaacactaagctgaaaaaggtctccaaggcctcccaggcagcgtttcccaaagtggattccaatgggatgtccggtgaagtaagagttccagggttaggctcctcttgaaaaagaataccacatttatctatggaaagcttgacgacattctaaaaatttaaaaaccttttaaactcagccttctctaaatttacttgatgacggaaatctcttttcacataccatccactactattccaaggtatggtgggaaatggcgcttgatggaattaagctcagtcacagaaaaagcactgatgatgtccctgctcgtggagcactgttctgagcactgtaggaaatgtacaggatgtggaagacgaagtccctgctagctgggcatgggcccctcaaaacgcacacctatgcaggctcagggtgttggcagtgaagcctgggggccgggggagccacagctctgtgccctggagcagtctaaggacctgggacgaaagacagagcagtggggttaaaaacatggggattttgaggccgggtgaggtggcttacacttgtaatctcagcactttgggaggccaaggcaggcagattacgtgaggtcaggagatcgagaccatcctggcaaacatggtgaaaccctgtctctactaaaaatacaaaaattagctgggcgtggttgcgcatgcctgtaatcccggctactcaggaggctgaggcaggagaattgcttgaaccagggagtcggaggttgcagtgagccgagatcacgtcactgcactccagcctggtgacagagtgagactccatctcaaaaaaacaaaaaaacaaaaaacaaaaaacaaaacaaattttggaggaaaaaaatgaataaaggaaggtgaggtgaggagcctcttgggaaatttttggctgaaatgtgttccaggtgttccaggacagagaaacaaattcaaggagcctttgaggacagaactcttcatgggctgcaggccaggccactgacctgtgtatggtctttagtatgtcacagatcatccttccccggctggccccaagcccctgtcctcctcaactcaccagcatcctgtgactcagccataccaggctgtttccagagaattatctagcttcacacatgatgttcctccatcaaggacccacccactgccctcccacactcccctcaccctcctctacacctcaggtctgtgcccctccccttctcagagccatcatctctgcctcttggggacttgcccagactctcttcttgtctttgtgtatacatctattacagtacttcccacactcaactgtaatttacttacaagaaatctatctcgttaatacaagacaatattcaaaagggaggttttatttcattcatctttgtattcccggcagtaccacatcacatgggatatgattggtgcttagcaaatgttgattgaatgcaagaactactcttaatttgattaggttgatgcaaaagaaattgtggtttttgctattacttttaaaggcaaaaaccgcaattacatttgcactaatctgataaaactaacctgatctcaaaatgatggccaagcataaccaattcacaaatgtgattttgatattttttttttaattaaagagctttgaatttttgaaatcccacctcccagaggaaaactgtttttagaaacatgtaaataggacaccacatgcataagaaacagcactataaagtgacttctcctccatgtctcagacatcagaaaagacaatctctggatgccattgcaggtacaggagccattacctatcacagacagtttcccagctggagaatcttgagttccgactaatcagagtcggatcgtctggtctcgctgccccaaacagctggtctgtacacacatcacactcgttcctcccagtggcaaagttccagtagggcaaagcaaaagactcattgccaatgagtcgctaaaagcaaagggcaggcctagtcatttaatccatgccatcagatacaacaagaaagcatacaaggcaaaggctgatatgtatctgaaccaaatatctaccaagacaaagactactggatggataaatgaatgaagaaactgtgacataaatcagtgtgtgtatattttatatatatatatatatatatatatatatatatatatatatatatatatatatatactgtgtacaatggagtattattcagcctttaaaaaggagaccctgccatttgcaaaatgtgaatgaatctagaagacattgtgccaactgaaataagacagatacagaaagaaaaacactgcactatctcacttatatgtggaatctaaagaaaagaagaaaaaagaaaaagagtgaatacatagagagttacatagtagttacaagggactgggagaaatgggaagatgtaggctgaaaggtgcaaagttgcagttatgtaggataaataactcgaggtctgagactatagttaacgttgtattgtgtactggtgatttgccaagagagtagaccttaggtactcttaccacacacacacaaaaagagatatctctatgtgatgctgagtatgttaatttactttagtgcactaatcacttatcttgtatgagtatcaagataagtatatcaaaattcacactgtatgccttaaatatatacaataaattttttaaaaaattaaaagaactaaatgcatagttttgacctacctggagatctctttccagacacaacaaatggtaccggtgccaggtaacaaatgcaggtccttgatgtgagaaatctatggccctgtaggggcgtcctggtcctgaaacaattgggaaacatattagagatgacagaatagaattttttaaaatgttaaatcttacctgggctgtatctatagagccaataagtccatgatgttttatagtagtaagaaaaaaaagttttgttgttatttatatctccaaaagcaatagtaatgacatgaatttcagaagtaactagtacttttaggataaaccctcctttatctcttaaaaggttgatttctagcagagatccaggaaattcaggtgactttcaggattgggagcccctgatacatatttaatttgtaagcaacaatccattcaggtgaaatagactatccaaaagaatagatcattaagacctaaaggaaatatattttttaaaggcatttgctaacctatgcttcacaaagatataaatttaaaagggagggattaattaataatattgtaacttcaactgcacttagtcctaatgcagtatttatgtaaccaaaaagaactttcgcgtattttgcctcacccatcaatctgttataactactagctgacaagcatgttcgctgagaccagaagagagaaaaatacattcaagccatttaggctggacactggaactgccaattttagtgaaaagctctggacgatttaatgacctccttactgcctggtccatccttcttccctttttcataacagctttgatggttatgtggaaactttagctaactttagttcttgtccaaaatacctataacaacttcagagagctgaacagacgtgaatataaatttaattcgtagctatgaccagaaactaggactttcttttcctcttgagagagtactctctcataaagcaataattcctcagagtgataacaggaaaactataaaggtttatagccaaaagagcctccttatctatcgataaagacagacagatgcttacctgtaaggcaagttttaaaagactcacactgagaaaagcactgctgtccctgatgttggctacacggccctttttcatgttcaattcagagcaaggtttcaaattctcagaacccaacaacgagagggtatcaattgaaggggaacaagtgatgagcagaaggatgaacctgtccaaatcagaatcttgctcttcaaagtgagcttgatgtcttcattcatcctgaccccaatgaaggaccccaaaaatggggagaggtgcacgtgcagccatgcattcaagaactgctatgggaagaatctaggatggagtcaagccctcctggaatacattggtgtctatggctttcctttgactgaaaaataaggacaaagctgaacctacttgatacatgaagtttgtaacagacaaccccctcattccaagtcctacccagcccccaatttttaagacttggaagggcaggtcaccaatttctcaagcatccaacatgactgtgttgcaaagagctaagcagcagaaactctacattgctgtggctaagcttgtacttttccttgacaataaagctccaagaaacctggggattccggaccatgcaggagtaccataaatgattatctgaaagtctatcatgtgatagactgtctaaaatccatccaaagttgatctatcctgtgagtttaacaagatgcccactcccaacatgagcactctaattccgcacaaagaagcttcatgtgccttagcacatgttcagttaattcctctaatttggagaaaaggtcagagagggcttccatggccagattcgcaaatattttcttctgaaatcaaaaggaattcgcctccacctcaccaactcacatctttgatgattaacagcttcacagagaaaagtttacactttgaaccaagaacatacggtagaggagagaacatttaaagtgtctgcatccaatgcacaggaagaaactgcttccttctaactccaggcggtatttgataattctacgactttcataaacctaaggctgccttgtggttgctctcttaattaacttgcatgaaattacttcccactgccataccctcaacccaatcacaaacctgtaataatataccttcagccaaggaaaaaacccacctaataatgtatctctaacagaataataatggagccacacaaaaaaatcataaacactgcagttggcaaactgcggctgggttccattgggcccaagcaggcccagccagtgttgtgtggtgatcacgtagtcggggtgtactctcttcttcgcgagatctaaggcgcccaagaactgctctctttcctgaggactcaaggaatggatgttctgccgaatcactggtggtttcttccgctcgcagttgggaccggtccagccaaacttgcagtctccacaattatagccggcaaagtttcctagttcacaaaacagaaagatggaaaggaagggggtttatgtcgtttggaagaaatttctgaatttgtactctgaaatttgaatggaagagaagatgaaggtgcttacacaaaggcaaagaaagtcaattttcctcccatggtctcctcttaaatgtttatatctccaagtggactaagcactagagggtttcctagacacattcccagcaaagaaacaggacatgaaatacactgtatactgcaatgagctaaaccgtgtccccgaagtcctagccccagtatacctcgtatgtgactatatttggagatagtgtctttaaagaggtaattaagggtaaatgaggtaattagagtaggccctaatccaatatgactggtgtcctcaaaagaagaggaaatttggacacagttttggaaggaagaccacatgaagacacagggagaagacagccatctgcaagccaaggagacagccctcagaggaaaccaactccctgatctcagccatccatcctccagaactgtgggagggtgaatttcagtgtttaagctgcctagtctgtgggatgttgttacggcagcagtagcagactcatgcacacactccttcctcccaggatcgcaggcgtgtctcctcctgcgtccactccacgcccacaaaaagggatgacacagaacagttcattgatttagagaaggaagaaaatacacagcaagctaaagatgaaaccaaaataaatacatggcttggcccggtggctcacgcctgtaatcccagcactttgggaggccgaggcgggcagatcacttgaggtctggagttcgagaccagactggccaacatggtgaaacctcgtctctactaaaaatacaaaaattagcggggcgtggtggtacatgcctgtagtcccagctactgcagaggctgaggcaggagaatggcttgaacccgggaagtagaggttgcaatgagccgagatcatgccattgtactccagcctgggtgacagagcaagactctgtctcaaaaagaaagaaaagaaagaaagaaaggaagagaaagaaagagagagagaaagaaagaaaataaatacataaattaactgatttctaggaatttagaagaaatctcacatttaaaaagctgacttatttcacgaagttgacagcattaagacaaaatcaacggaagctgtcaagtcctcagggtgaatcagtagccatgatgtcaggaagtacaaaccaccacaggatttctgtcagctgcacaaagctccctgctttctcaaagcccagggaaggaggacaggactaataagatcaagctctgggcatctctctgatcagcatctaaagtttacatccttgtagcttgccccagacttttcccttcttagccttccaacttattgcctttgggtatgaccaacatttcattccttaggttagagggtaaaatttaaatatcattagagcacaagattgaaacgaaaggggatgataatgcttatctcccagaagattaaagggattacgtaaagcatttaaagagggtgaccagctcacttactcctcctcctctacctcatgccctaggcctatttgcttgcttttccttcttcctgaaacacttttccctcactgtctccctaaattcctctttacctgcgtgatccatttctcctttaagcttcacgtttgtgctctctaaggtcattcttgattccaaaggtcggggttcgggtcagttacttccttgcacctcatacatcccctttcttcacatttatttacactgattgtaaacattactacacttgtttcagctccaggcagctgtaaggctgtgaactcactgcctaggcctgtgcttagccttgttcaaaacaaatgtgtgttgagtgaataacagaagtatcgagcatgtagcagatgatgccacatacattttctctccctgttctgtgggtttgcagaaaaagcagcccctataaataattttggtaaactacaagtagcaaaatagaggtaagtaaaaagtactatgaccataggggagggggagttatttggatctctcaaggaaaggaaaattttccaacagcatgaaaacaaaatgattaacagcattctgtaaagaaaatgcacaggcttccttttctacagtggattttctgatagttaaagaaaatttccttaaaatgtaagtagggagaattttttctaattgtaatcggttgagtttttttgttttttataatatatcatatatcccaccttttacgtagctcaattatctgtatttttcttttacagcactctatgagaacataagttaaaatattgaaaaaaggaaaaattctactcttcccaagactaacaatgtttttgaatagtttaagttaaacattaaaatgtacattgattcctggagataattaaatacaaactatttatttaacaaatatttatgaagcggctactatctcatcagatgctatgcaagatgcttcgttttatggaccttgaagtctattttccctggggcaaccttactaaaactgtatgtattaaaaacagatttgattaaaacatatcacctactatgacagtacaggaatggaacactgttttgagaactgagtgaacaaaatgctgtgtctaaagaagagtagctacccagattaaaattcagtcaaatttccagctgcctatctatagctgattggaggtaaatgtctagtcacttctctgcagtagaagagtaattccttgcttcataatgctgagaaatttggatgataataatgtcggtagaggttcattgattgtaaccctggtttgcggatgttgctagtggaagattgcagagtgtgggggagaaggtagatgggaattttttgtactttctccccaatttcaatgtgaatccaaaactgatctaaaataataaagtctcaatatttaaaaatattaataaataacacacctaaaatttataataataatttaatacctttttacatttaaaggcataacacttgtttttgaattgggggcctgactgttgaaactgagtcattcataacttatgccatgaatttgaagactactcttattttctttgccatgattctttgtagttggcagaaacaaaataattggctctctcatgtatttatttaacaaacaatttattgaacagctactatctaaaaggtagccaacactaaacatgcactgacagtgagggagatgtgagtgtgtgagggcagggggttggcaactctctgtacttttgactcagttttgctgtgaacctaaaactgctctaaagtctattaaaaaatacaacaatcaacacatcttcctttatgctaccatagcttttatgttataaaaaacaagcacattaatgtggagcacatagaactacatctggtatacagtgagttaaatatatacatacatacatatatatatatatatatatatatatatatatatatatatatatatattttttttttttttttttttttttttttttgtcaagacagtctcactctgtcacccaggctggagtgcagtgacgtgatctcagctccctgcaacaaccacctccccggttcaagcgattctcctgcctcagcctccctagtagctgggattacaggtgcacaccaccacacctggccaatttttgtatttttagtagagatggggtttcaccatgttgggcaggctgatcttgaactcctgaactcgggtgatccacctgccttggcctcccaaagtgttgggattacaggcatgagccaccgcaccctgccgtgagttctatattgtgttattattactagtattattagagaccacttatcaaatagtatagcaattgtttgtcttcatatctgtcttacatatgactatactgtgcacatcttaagaatcacgtcagtttttccccctctctgtatctgaagggcctagttgatgctaaataaatgttgcttggatgggtggtgaaagaatcaatgaataattgaataaaagggatcagacactagtgaatacaaatacagatggcctctgacttatgatggttcaacttaaaatttttcaactttaggatggtgcaaaatcaatatgcattcagtagaaactctacttcgaatatccatatgactattttggttttcaccttcagtacagtatttagtaaattacatgagatattcaataccttattataaaataggccttgtgtgagatgctttgtcccaactgtaggctaatgttagtgttctgagtgcatttaaggtaggttatgctaagctgtgatgttcatagattaggtgtattaaatgcatttttgacttaacagtattttcaacttatgatggattattgggatgtaaccccatcataagtcagggagcatctgtataaatgaggcaataataccttagtctagtggaaatgaaggacaagtacacaatgacatttcaacacaagtcaaactgtgggaaaagtgaaaacagaggaataagtcaagctccactggatgacaaatgacgaaatgattaatcctgattcagaaaatcagagatgcttcacaactacagtgaacaagaaactttaatgtaaccagagttgcctccaaaaggcaatgtataagttctaataagaaagctttcaacatctgtgaaaagaatgggaagtgggggggtaaagaaagcttgtgtctgttttggagcccatttatgacccagaaatttattcaattaaaaaattccttttccaagatgtctcagagaaattattccaaagctctgcagtcaggtccctttcatttctaagtttatagacctgacctgaagaatttgttgaaatgctggagatgactgaaaagtgtaacaacatgaaagcctagcagacaaaatgtttatttctttaatttagttttcctaatagcatcttccatcaatttaacatgatttagttttttcttcttaatctaccaatgcaaaaaatataagaagagaagtgttttagaaagaaccgtgttatcttactgggaaatggagagaggaaaaaaaatgattcctagataatatcaatctatcgaccattgagtatgtccttcagtgaaaattaaatttaaagagtcaaagtctcatgtttacaaaggactatgataaaaatggaaaaaagagtgagatcatctaaacaccacacattcctacatgaactgcatcagctcaacctcagaaagccattagactaaataagcttaaagaccaccgattagtgaatttacaaggaactctaaatagcctattccttttaattagagattctattattttaataacaatactttatacttacataggtcctttcatctacagaaatcaaaaggattttacaagtgtggtttcatcattatccccatttcagagattggaaaatggaggcaattagtcacttgtacaaacaagaagttcaccgtcaactgttcaaaaactatttggtgcgcaagtttttcagaagccaaaagacatagctgcaaatggcatattctcataaagccaactggcaggtaagccttataaggtgaatagcaaattcaaagtctcctgcaattcagctcttcctgacaattaagctcagtggcttttttgtttcaatttatccctacagagactatagagaagctctctacagagaatttcaccatagaatttagagttttaaaaaacaaatcccagaatttctatgtgtttctacttattaggctgaaattactttaccagcttcatgattatggaaactatgaggtgtttattttccaaagaattaacaacatttggggtcatcaatagtctgttacaagacactaatctacatctcttccttgagaaattttggatcatcccaggagtgccccagtgactccattcgcaaaagagtcatcaggctactgtagaggatgttctctgggaggctcaggatcaggtttcaattccaaagattgccccacaaaccataaaaaagctaccctaggaaggctagcaacttactctttggggaataattaattgaaggacatgtgtcctgctttgggacacacggctcatcacagaatggtaattatgacatacacaaaataacttcccagctcagtcactaaggacttagtctcgtgccctgagattcaaagaaaaagaccatctagcaagataagtagagccatccaaagttggtatgacaatacaatggaatattattcagcctttaaaaagaaaaaaattctaccatttgcgacagcatggatggacctggaagacatttgtgctaagtgaaataagtcagtctcagaaggacaaactctgcatgattattcttatatgaggcatctaaagtagctgaacatagagaagtacacgacggaattgtggttaccaggggatgggggaggggcgatagggagttgtaaagttataatgatacaagatgagcaagttccagagattttctgtacaatatagtgcctatagttaacaataaggcattcggcacttaaaaatgtgttaagagggcagatctcatgttaactgttcttaccacaaaagcaaaaaataaacaaaaacaaagaaccacgaggaacctttggagatgatgaatatgttcattatcttgattgtggaaatggcaacacaactgtataggtatgtccaaacaccatattgtgcacgttaattatgtgcagtgttctgtgtaacaattatgcctcaataaaactgggaaacattaaaagtctagtaaattgaacttatagatacagtaaatcttaagttacctttaaaaaaatgtaggtgtggaaagagttctgttcctgatgagtttggactgagcagatcacggggggaggtgagccacagcctggagatggggcctcagggccaggccgggccttgacaatggctggagaggcagaccatctccctggaggaagccctgcttctttggactggcttatgtacatgggacttccttacagcctggacttaaagaacaggccctatttatttctggcccaagggctttttagagcagggggagcctctttttttttttttttttttttttttttgaaggtaggtctccatgatcctaagttcctattacttctagagcaatatttataaacatttccttaccaaagggaaatagcaatgatcccttctattctttctatccctacctaaaacaaaacaaaacttgctagccatggcaaaaatatgaagaagctggtaacaaaaagagtttatggttatatgtgacttcctaaagtcctctgcctcaggattctatgcaatgcagatttacaactttttgaaagtgttggcactttcttttttttttttttttttttctgagacacagtctcactctattgttgcccaggctgcgtgcagtggcgcgatttcagctcactgcaacctccacctcctgggttcaagtgattctcctgtctcagcctcccaagtagctgggattacaggtgcccatcaccacacctcgctaatttttgtatttttagtagagacagggtttcaccatgttggctaggctggtgttgaactcctgacccgtcttggcctcccaaagtgcttggctcccaaaggcgtgagccactgcgcttggccagcactttttcattgattgacatagaaataattgttctagaagtattttggggttttgaacaaagaagttactgtgttagtgtggttttcaatcacgctaaccacaccagcaacctgctcctcattcgtctaaaacaccatgataattttgagagaaggtctatagaagcaaatgcttaaaaaacttagaaaagctggataatatatatccaatatgttattgaaatttttgtcatgattaatacccagggcaaaaccaggacctagatattcttctgaatgacagaattaaaaatattactacaaaatgattataaagccagaactatttatttatttatttatttttttgagacagatctcactctgtcacccaggctggagtgcagtggtgtgatttctgctcactgcaacctctgcctcctgggttcaagagattctcctgtctcagcccccagagtagctgggattacaggtgcctgccaccacacccagataatttttgtatttttagtagagacaaggtttcaccatgttggccaggctggtctcaaactcctgacctcaaagtgacccacccacttcagccttccaaagtgctgggattacaggcgtgagccactgcaccaggcctaaagccagaactcttaatgtgaaaaaagaaatctaatgtctgggcactcatggacataaagatggcaacaataggcactggggactgctagagaggggagggagggaggggtcaaaggttgaaaaactacccactgggtgcttcgcacactacctgggtgacaggatcaatcatatctcaaaccctagcactgtgcaatatatctatgtcacaaacctgcacttgtatccccaggatctaaaataaagttgaaagttaaaattaaaaaaaaaaatcgaatgtcattcctacaccaacatcacaggcctttgtatgttcccttagtaatacctattcaaccccttatgaagctcaatgacctatatcctcctatgttccagcatcctatgagaagagaagtaaaaagtatttttaaaaggaaaaagtcttctgcaaccacccagcctacaacagtgtccaagggctttcctgaggttgccacttgtgttttttgtatttcagtggccccctgccaggctttgagtgtttattcccgaagggcatatggctgctggaaactggaggtgggaaagattgaagaggatttgaaaaagccccaaagagctagaggaatgagaaatgcacagagatgtcaaagcaacaggtaatgagagagaccagagtctaaaggaaggacactgagcaaattttgtgatgtccggttcaagtccagagaagagtgacaaaaagccattgttatctaataacaaccccccgcccgccccccccacccccagctcctcgagaaagctctgtcttgccacgtctcgacaattttgtcaaagttacaacctggtcataagctttaatgagaaacatgcaccctgctgaggtcaggagttcgggaccagcttggccaacatggtgaaaccccgtctcgaaatacaaaaattagccaggcatgatggcgggtgcctgtaatcccagctacttgggaggctgaggcaggagaatcacttgaacccgggagatggaggttgcagtgagctgagatagcaccattgcactccagccacggtgacaaagcgagactccatctccaaaaaaaagagagagagagagatctgttcaaatcatgagaaatgctgagaccagaacacctgcctttgactcctgtcttccgaatgccaagcttcacccatcccttttcaacaagtgcaaacccatttcaggagagggcaccgaatccatcttgaaaggacttgctccgagtttcaaagctgacgcttttaagctcttaaattccccttccaacaaacaagccaatagtatgttggcatgcattcatataagcaggcttggcccacgccatatttatttagtcttcataactagatgtactagagggtgtgaagaataaaccagcacatcagccttattgaatatgcttccgaccaaaaccatcattggtttgcctttcaaagcctaatctaagagtctctgtcaagagtctcatctcttccttagaaggagctctttccccagctctggccctccccaccaagcttggagcatgggcctcacctgtgcacttgcaggtccggtggaagaattttcttggccacagctcacggtcatcctggtttcgtaggatgtagggaccactccagggccttgtgtcggctcgcacctctgtgcactgcccccggccttgctgagagccacagacattggccgactctgcacccaggcgtgggcagcactccttgttcactaggctgtccaccgtcatgcagactcgggggaactgaccctgggctcctggcaggattttgcagcccaagcaactgagcagaaacccccaccaaagggggctcatggctttataattgggagagctctctctctctcttactttccttgtctctgtcgtacttttctccttatcttctactctttcagtcttttcttttcagtattttttatttttctttgctttctattcctttcttcttaaaaaaatacccacaagaatcacagaggttacatgtgtgcacatgtgtacatgaacgtgcacacacaattttatgtgattcaaacaactaacagacttaatttccttagaagcgcctctaacaaccaaatttaatgagggtagcgcttctcaccatcttcccccgttaagtcaggctttgtctaattgagttaatttacagagcacccagtcatactacttattatgctggtatttctaaaccctctccctccctccttagctcttgactttaattgccttgaactcagttcaaaagccaaacaccgtgctgcttttattctctctggcttgccaagccacggggccttgggggcttgtgtaagggctgggagaagccttcattagggggattagtattacagaaaccctcatcattagcacatgacccaaagtgcacaataaaggagatcacttctggctttatttcaggagggcaaaaccatcttctttatctgggctcatgtgctccagccaaacttgtgacctcagacatcctggggagtcagtagatgcagtgagctcttcgtcaaagaccctttacacagaagctcacattgccaactacaatgcactcatggctgctttctgacatgtgtgcaaaaaagaccacaacagggggtcatgcaacttcaaaaataaagaaacatttatgtagaaccagggtacaaggaattgctttgttccacaattgggaatcctcttccctccaaataataacttactcttctcctattcagcacatctacgcagcaatttttttttaattacatgaagtagcatgccaccagaaactcacaattgtcattatctgattgtatggaaggcactggaaccatttggaatgaaggcttgcaagcaaatctttttgattagactaaagtgaagcatgactgagcttcagtctagaaagcaatgcctcctggtgcttctggagaatggtcaggtcagcaatggtggccacctgtcagaacatccatttattttttcacagtggaaacaggactgtcttggtaactgtttcacagtggaaacaggacttagtgccacaaggatgcgaaacggcttcagctagtttctaagaatatacttgaatgtaaagacacatattgttatgtttcaaagcaaattcctaaggtgaaacaattatataggtattcccaccccctgtacctctgtgccaccccttgatgttaagttgttgtgactaattaaatggcaattcttatgtctgactctacaccaatatcagcctgtaccacagccctactgaatcagaatctctgaggatgttccagacaccaaccaacctttgttagaaaacatctaggcaattctaatgctcagccagagttgagaatcactgaatcagaatacagcagagctccaaaggaaatattgcatcagcatcagctaaaagagaccatgtgcaatagtttcctgaggcttctgtaacaaatgaccacaaactggatgactgaaaacaacagaaatctattttctcactgttctgaaggccagaagtctaaaatgaaggtgttggcaggactggcgtgtgtcagccaggcggctgcactctccctggagactctaggctagaatcctccttgccttttcaagcttctggcagctgctgtcaatccttggcttgaaaccgcagctccaatgtctgccacagccccatggccttctccccatctgtctgtgtttttcctccatgtctgtttcttataaggacacttattggatgtagagcccactcagataatccaggatgatctcatctcaagattcttcactcaattacatctgcaaagaagactcttttttccagacaaagtcacattcacaggttctgagacatggacatatcttttggggaagtcaccattcaacctaacacatcatgggtgggaagaaacttggggttctaaaatcgcaaaatctcaggggtttttgaaacctttattttggagctcattcattcattccatgtatatttattgactgccacttcatgccagcattgtgacacttgggaattttattccaggtttttgtgaagccttggggctccataaatgttaagataaaatttcttggatgttaaaactgatggagtcaataattcttatgtcagaatgccccaggtcgaagtcctaggatctcttttctttcatttccacacttgctagataactcagctagtctgaggccttaaatgcaggctatcatgactttccaaaattacaactctgactttgacctcagttgtgagccccagactcatattatctaacttcctactggacctctctacttgaaggtttagatatttctcacccaagttgagaacttttgctctctcctcccaaatgtgttctccattggtcttctccatctccacaaagagcagcatcaccacaaccctacaagtgatctttgagtcttctctttcccacctccccatgtgtgctttccaatgcacttcaagtaaaatccgaggtgctttgcatgtgctactcaaagtgtggccaacagatccgtgaatggtgtgttcctggtttacatcaagttaagaacaataagaatagaaattgagagtcaacactgggaaattttcatagcaatttgacattgggataacattcaggcatacgatcagtagtttcattcaagaggggagagtccggctgtgaggttgccaaacgtgcatggtgatgatcacggagcacaggctgaatgcaatgagtcatgtgcagttggatcacgtgttagtctgtggctggaacatttttcttttttaatcatttaccatggatagtttgagaactagcttaaaagatcctccatgatttttccctcgcctgcctctcaatctcttcttctggatggcagactattgcaatcactattattcaaacatgcccccattcatttccaccttggcctttgtcttgccattccctctgtctggaataatcttgctcagagccctcagcttctcagagaggccttccatgatattttaacacgtctacagccagccaccttctctctaccacattaccttattttattttcttcatagcacttatcaccatctaaagttatctgacttattggttaggtggctgaaagactgtctcatctactggactataagctccttaactctgctgtgtttttccaacatgtgcaacagtatttggcaaatagagactacttgataaatagttgatgaataaatattcccaattcaaaactgtatgttcatcaaaagggcctcattattatagtgactggctttatacaaattaaatgcttttattttgaatatataaaacacttaggcttataatgaccactattatattgggggtttcatattaggttttattaaactgctgcaaatgtttgaaaaccaccaacccaacatcactacaacccatgaactcccccctcagtatttccaacaaaatatcactagtgaggaggttctcacaacatttcaggaacagttctaagggtgaggaaattcttccttttcaataagtttttggcctggcacagtggctcatgccttgtaatcccaacattttgggaggccaaggcaggcagatcacgtgagcccaggagtctgagatcagcctgggcaacatggtgaaaccccatctctactaaatatacaaaaattagctgggcatggtgacatgcacctgtagtcccatctagtagggaggctgaggcaggaggatttcttgagtccaggaggttgaggctacaagtgagccgtgattgcaccactgcactccagcctgcagaaaggagtgagaccctgtctcaaataaataaacaaaaaaaagtttttaacagtaagtataatttaaatgtaaatttaaacataaatgttaaataaaaatttccttccccaattctttcatcaaaagcctttggtaacccagtcaggctccatagaccgggtacagtccatttcccacaggcgtttctcccttttttttttttccagactaaatattctccattccttttcattttctttcatatgacttagtttgttttttgtttttgagacagagtctcactgtgtaacccaggctggagtgcagtggtgcaatcttggctcactgcaatctccacctcccagtttaagcaattctcctacctctgcctctcgagtacctgggactacaggcacccaccaccacatctggctaatttttgtattttcagtagagacgaagtttcaccatgttggccaggccggtctcaaactcctgacctcaggtgatcctcccacctcggcctcccaaagtgctgggagtttacaggtgtgagccaccgtgcccggcccatatgacttagttttaaatctccccatcagcatggtcttttttacggacaacacagttcacgatttgacctctgaatgcaggtttcccataacttaattcaatgttcctgctacgatctaagcaaagataaccgaaaaagaattaccttgtaagctttgctagacagtcacatcacctcatcaattttgtctacatccactcaggctaactcacgctgcagttaagacctcaaaatgttatttggcttataaaagaaatgtttatttcttatgcagctgcacatccaccacatgtcagctgtgactgtgctgtacactgtgttcactccaggacccagggggaaacagcatcttttcattcttttcattctgctaattttgcgtcaaagtagaggtcagtgatgggccactacttggaagaggtccaccttactcacgtctgctcccaccccattggcaaaaagcaagtccgcgggcaagacagctgctctcaaagacaggggttctgtgaggatggcccctttagggagagtcaagaagtattttatttttactgcatttgaaatcaacttaaagccttatgtcattttcatatagctttcacaaggctgccttaaagtcagatgcctctcatatccccatctgctcttctattcgtatggaattgccttttgaggtctgtattagtttgctttggcttccataacaaaatgccatagagtagatggcttaaacaacagaaatgtactttcccacagttccagaggctgaaagttcatgagcaaggcatgggcagggttggattcgtctgtcaaggcctctgtcctcggcttgcagagagcttccctattgctgccccatgccatggtctttcctctctgcacatgcacttctggtgccttctcatgtgtctaaatttcctttttttatacgaacactggtcagattgaggcccatcctgacgacttcatttttaacttaatctcctctgtaaaggccctattgccaaatacagttatattcttgggtgctgcaagttgggaattgaatgtaggaattttggggaggatgcagttcagctcctaacagggtgtaaatgaaagggtttattttgcctctgtccaatgttgtcatattaaatgggtgtgataagcaatgggatttctctcattcctgcctttgtcctaactacacatttggttgacccgtctttattgtcttcgtaacccaattcattgatgaaaatgaccgaatgtcaaggtccatggcaggacttgagacacgtcactcaaacaaaagcgtctcactctggcactctgctggggggcggtgggggggtggccacaagaggaacttcagggggatctttgaacatcctgaaattgtgaagaaaatgtagcatgggtctttttctgttaagaagattcatagattttgttagcttctcaaatggattcatgaccctgcccttgagactttagcacaggtagaaccttggagggctctgtgagagaacttagagactccgagcatcatcagtgtttccaaaggatgtcatggccattaaccaccagtctgcttgtccacaatggaggcacctgtatagttcactgcctttctcctagaatggcagagcccctgagctttcctgtactcacctggtcttaaaagaaaagccttaaatacttaaaggaaaaggcttaaacgaagctgcaatcccatcaaccttgcacaaacacagtgtctggcacataggaagcactttcaaaataactgttgagtaaatgaaccatcatctatagtatcctccccaaattcacaatcattcctaataaaggcaggtcactctttctctcacggaaacacccagtttgaagtcccatatcttgaaggagagcagagaaaacaaaatgggacaggaagtaataatactaatgcttgataggtgagaaagggctaaaagtattgattatttagccaagagaattgctagggagtgactgattttcaaaaagataaagagatttcctttggatttggaaggataaggctgcaggtgatctatacgttgtgaagtgctcaatgtcattgggtttgtggtcttttttagttcctacgcgttgctcgattgcatgattttaaaagtaagaaagcagcttaatgtattaagtccctactatgctccaggcactaagctaagggtgagtatgtaatgtttctagttatttattcactggttattatcctcattttacagaagagaaaacagaggctgccagacctcgggtaacaagctctgtgacagagctgtgttttcctgactccaaagttgtggtcttttcaccatgtcgagttgtcaaactcatcattttctctggggaagtcagcacagtgcctcatacaaagggactgatggaaacttacaatctcttatctcctactccatgccaggtactatgctaagcttgctttccttaccttttgttatctcatttaaattccaagaaactgctgcttgaaattttagtatttctaatttaagtgaattgatttaatattgctaccctagatggaagccctaagcacgtcagaatagaattaagaaatcctcattctgatggaggagattgattgaagttgagaataagggttgggctcctcctagccttgcattaactaaattaccctttagtattaagccatcagcctgcattagggcatgatttggaaaaacatcctgtgaaacttgtaaggtatttttaatatcatcaaacacatttcccaatgtcattttatggggatccagggagagatttcttgcaggcttcagtatccaggaaagctgtacttccccatagaaagcagcttatccaggactgttggaccatgtgaatcttaggatggtgtttctttctttaccttggccagttatgaagcttggagccaaatttgcagcccccacatcaagcaactgattcacgcagtatctactttaatattctccttcccttatgttcctgggttctgggattcttattttatccttttgcaaatttatgtatttccctagcttgtctcaaatcctttgagaaataagacaaacacacacacacacatttctgtgtaagtgcaaaggtaacaaacacacagccaagttgttgtttacaaaacagggcttagagaagagttcaagaagaatccctaaaaatttggtataagtgaatacagacctaaggacataagctaagaagatctcaaatcataagcatgactgtaattaaacattgcattatttgcaaaagagaaagtctttgttagaaactgaatagcagaatccaagaggggatatctcatgggtgtattgagaccattggttaccaatggaagccatcgaatcaaggactactataaggaatgttctgaaagccagtaaagagaggcagctgtgtatcatacagcttaatagtctgagagtagaaaagtgccttattagaaagcaattcattttactctctctttttacagctgaggcaagactaagtgaaaagggatgttctgcatactttcattttgcatgccggcacctagcaccaacttgcacataagaaggactcaatgtatgttcatgacatactgaattagataccttagagaatttgtaagtggatgatgcagggcagacatgcatagctttggagctaggatgccagcctatgccttcctgtgccagtctatgtgttcaaaggaggaagaaatggctcaaagcctgggaagcaattgaagagaaaggtagatgtgttagagccatggctaagattaatacagagaaaacatatgcatctttctcctgcttgccaacgagttgcctgctctttactcctgtgcctctgaatgtgaaaatcctccccgttttttagccccctgctcaccttccctgtctgatggtttttgatctattctttgctgcctcatcatggggaaaagagattatttttttccctgtgaccaagttgtttcctaaatgctggacatctgtcctgataagagttttgctttctacatctaagagccttttttcttcttggtggtatgaattgttcttcagaggaattaagggttagaaatgggacgtgtggtctgttatttcagttgagtgcatttttttcatcttgaatgcattttttatagttcatccttaagtctgtgtttatacaccaaacactttttaatttcagattttgcatcatttatctttatattaatcttagttatttgctatgcacactgtgccctctaattcttattttatcattgttttttatgcttcattctggtacatgagtattcaatttggatttttatgtgtacccttataatttaatgactgatttgggtaagcaatagagctactccttcttcaaaatacagttctatgggagggaatcactctcttcctgctcaattctgatcaaatccagaaaataccacctatacatttgtaagaggttgtatgggctgaaaaaatatatatatttttagacaactttagtactaatggatctaccagggtttatagatgtacaatttagactgttcagggtctagaaggatttccaaaatatgttgtctgccaggcacggtggctcacacctgtaatctcggcactttgggaggctgaagcaggaggatcacttgagctcaggagtttgagaccagcctcggcaacatggcgtaacctatttctacaaaaaatacaaaaattagccaggcgtggtggtgcatgcctgtagtctcagctactcagggaagctgagatgggagaatagcttgagcccaagaggcagaggttgcaatgagctgagatcgcatcactggactccagcctgggtgatacggccagaccttcttgtctaatatatacacacacacacacacacacacacacacacacacacacacacacacgccatatatatacatacatatacacacacatatacacatacatacacacaccatatatatacatacatatacacacacatatgtacacatacatacacacacatacacacacaaacacacatatatatatagtcaagagaaaaacataaggtatatagctatgaactcactatgtttatgctaacatgtacatgtgagggagtgggggcagggagtatgtctgtgtctgtgacttgtctgtgtctatctgcccatctgtgtgtgtcaatgtgtagaataaacacaagaaactggttgagtgctgtctgtgggaatgggcctaatggggtgaggaacaggagcagaaagaacaattattttcattctatatttttgtacattttgaattttgaaccatgcatgtatagtacttagtttaaaaatttcgttaataaaaaaattcaagttaaaaaaatttggaatgatgaggacttgtgaggatgacattacataaaggaggagtttcctggaagtattaaaaagagtataacccagtcaaaatcccagcaagttactttgtgaataaggacaaacagtagaggtttatatggagaggcaagaaacttaccagttctatgaccctggacaagtggttattctctctcagcctcagattcctcatctgtaaacccaagatgaagatatctacttaataaagcataattttaaggattagatatggcattggatataaattgcctagcagaatctggcacacagtaggtacttagcacatttttattacttccattaaacaatgcctcaaatttctacactggcaaaccactggtctgacccattatattattacttgtttgaaaaattactaccttcataatcagtagcccatatgacctctatttcaatggacagccaggaaggggtgaaagatcttgccagagtactgaaaaatcctctccactgagaaaattttgattctaggaatgattaatacacacacacacacacacacacatatacacatgtctaagcatctaattataagtacttctaataatttttttctggaaactaaataagtatttataactcacacatagaagatattcttgtccataatgcaatattactacccagaaatgaagttgttttcttcttagattctgcttagtcaaatgatgatacgctatgtttacagctatgctattctgttagccttggaacttaggaatctcactaattatgacaaatataggtggaggcaaggtttaaagaagccacagagaatgaataaaccagataggagccctcttactaatttcaagagctgacaaaaataaatgctatcattaaaaataaggaaaaatctttttcaaaaatttcttgacctgaatctggtggttttacaccaagttcattactttatcattgctgtcaaaaaccaactaaccaaagctgggcgcagtggctcatgcctgtaatcccagcactttgggaggctgaggtgagtggatcacctgaggtcaggagttctagaccagactgaccaatattgtataatcctgtctctactaaaaatacaaaaattagctgggcatggtggtgcatgcccatagtcccagctactcatgaggctgaggcaggagaactgcttaaatctggcaggtagaggttgcagtgagccgagattgtgccactgcactctagtctgggcgacagagcaagactcggtctcaaaaaaaaaaaaaaaaaaaaaaaaaaacaactaaccatggtgtctgtgtctgtctgacatttgctttaaaaatggttcttctcattgaatctcacctgcactcattcagttacttttcatggaccacgtgtgcatgcacacacacacatacacaaagctaaaaaaacctccaaactttcataatagaaaagatatatgtacttacaaatcatagcagacagctgcctagtaaatgtaaattttgttgtaatgaatttttcatttctaaaaagtattctagtataagaaggaagacacactgaaaagtagtagaaaacaagataatttcatagaggtttcagtttaccttcaattatgagtttataatatgtaatatttttgtaatcacaagatctattgaattcaggaaagttacctatttatttatgccatgaaatggatttcaccttgagcaccaatgattcaaaggccaggttggagctcagcagaagagtatgtaataatggaggggtgagcaaccttcttgtggaaacatttagtcctcaccgaagaccggaaagaatacaaagatgtcagtgaacaagaaaagtcagggcgcttttagggactgggaaccatagagagtaaagagttcagagtaaagcttccacaaactgagtgcctcaaacaataaaaatttatcatctcacggtcctggggctaaaagtctaagatcaaggtgtcagcagagccatgctccctttgaagtgataggggcggatcttttccaggcctgtctttcagcttctggtagtttcttggcttgtaatatagaactccaatcttaatatgatgttcttcttgtgttcaaggctctgggcctgaatttccccttttatgaagacaacaatatattagattaggggcccatcctactccagtatgacctcatcttaattaattattacctgcaatgacctgactcctaaataaggtcacattctgggttactcagggtttgggcttcagcatataaatttgagaaggacacaattcaacagataacagataataaacggtgaaactgggcatcaaaactcaaatactcattctctttttacaaccaagtcatcctgaacacatcctcaaacttttgggattagaaggagagttggtatgggtcatgctgtatggaagagaaactgaagagaagtgggtcaccatcataagacttagctgctttctggtgacatgaagaattctgcttaatctcacggaagtgccaaattgggtgtaggggagtctacttctgcaaaggttagcatttgtcaatcagtactggatctcctctcagaattctgcagttagtcctatgcatggtctctgtgaaccatattacctcataaattttagatctggatgagaagttaaagatcatttagaccaatactctcaagtgagaaaatcaaagcccactcagagtttagaataactcattcatgaccatggagcctcagcatcctgattcatagtgcagtgctcttttctctcactggacaaccaggggtgagtaaaacatgagatctctcttacctgttatggacacgtttttctcccctcacctttgtctcaagcatcgcatttgtaaaactcactcttagctcatcgttctcccaactcaacagttaaaggcagatacatagaaagtgctcagtatttattgaatgaacttataaatgacagcagagaagcagcgagccttaaagataaacttcaactgaaatatccaggtggcctcttgaatcacatgcccctccctctctacagaggggtccacagaactcttttgcttcttctaagttgaaggtggttgggtcttctcctcatagatgtttcctctgaactaagcttgaggttcccagaatggcagcagctcctcttcctgcaggagattggacacctctttgtgttccagggcaacatgactggctatgcctgggggcttcactccctgccttctgttaatatttatacctaatatctaacacagtgcctagcacaagtaactgaatgatagaccatgactattacttggactacaggatccaagttagttggggatgggaacttattccaaattacttgctaatgtcttccaaatcaaacccccaaatttgaggtttaatataatttttttcacattatttataagaaacattgattttagaaaaactgaagaacacaaagatgtacagaaaagaaaatgtaaatcactcatgttctcaccatcaagaaattattctaattaatctttgggtgtttatcattccagatgaaaatattcattccttcaatagctttttaaaacctaattggaattatagtatatatattttcatagtctatattgacccctgatcgacgtacatattgaaaatgctttttccaaatttgcagttgtcaaagtacagaggaaggaagtctgaaatctttgctcaatcaaaacatggcagtcatagagaatggcagcacccaaggcatccattgtgcttggaacgttcattgtatccaatggtgaaaaatgcttcacatctgtgctcaagacaagagagactcttttgcaacatgaccccgaagaaaagaactctgtgggctattttcagatctaatatactctataagatggtttttgatattagggcacatctctaattccacattattagccatcatcctaagacttgccagcttctcgaaatttagacttctacaggatccaagggaaatgcctgccccccacgacttatgctgagtgaaaaaaaacctgacaaaaatagtacatataatcatttatataaaattctagaaaatgcaaactaatcttaagtgacagaaagcagatgagtgtcggccagaggacagagtggtaggtatggctgtgagaaaggaattcccaaggcatatgaggactatgacagataaacattcattaccttgagtgtgatgatggtttcactggtgaattcttaggtgaaaagtcatccaatggtaggcttgaaatatgtgcagtatattatacatcagttatacctcagtcaagttatggtgacatgcacaaaatgacatggacagaataaaatgtatattgctaagtctgaaagggctacatacgatatgattccaactacacaatatcctgggaacatcaaaactgtggagactgtaaaaagatcagtggttgccagaggcttgtagggagggaggaaaagatgaataagtggaatgcagcgggtttttagggcagtgaaactattctgtgtgatactgtaacagtgaatgcatgtcattatacatttgtcaaatcccacagggtgcacaacacaaagagtgaaccctcatgtaaactatgggcccaagttaatgattgtatcaacagtggaaacagtggggcagtaagaggctgtatgggaactctttctactttcggctcaatttttgtaaagctaaaactgctctaaagaataaaggctattaatttttttaaatgtttagagatgccaaaagctataaaattaggagattccacctaaaagtctggatctcaagctcatcccaaaagacaagaagctccagaaatcctgcattaagcccactcatggctccccaggatctcacagctagtgctcctcgtccccatacattgccacctggccctgcaggcctcacagcttttaacatctgccttctgtgcttggcctccccgatcctggctcctagccagagcccaggaaacagtttccttagaggggcattttgattgctttgtcactattccccaatctgcatcctttcatcattttgtttgtgctccttaagtctattttaggtgtaatcagcctcactgatttcactaggggttctctgagactagtttctcctctatcttcagggatttcccaggcagggaacgcctaattggtattatttgctgatctcctcttccttcactcagttttgtctcattcctgctgtatacccattctccttgcaacagcaaaattaggaagtaaatgtgtggaattttgtttaaccctttactcgctagcctcctgcaggtcttccctagcactaagttatcatttactctgaaaactttctataatataatgaaggaatgattcactgcattatagaaagtttttaaagtgttaaagaaacagaagcagaaagtaattaatcactactccttcactcagagataaccacagcttacatgttgatatttatacatttaatctttattctgtgcatatacataattgaaacaaaattatgatattacattctgcattattttttccatttaacaatatgttatgcatattttttcatatgattttgaagggttatagaatactcattgtatagtagataattatgatgtcataattgatttaatttccctgtttttgaatatttagcattatttacagcttgtcacttgtattaataattctgcaacaaacatcctcgtcaattaatctttgccctcctctatgatattttccatgagttaaattccaagaagcagactgttcaactacatgcttatttatattttctttttttttaaaacagggtctggctctgtcactcaagcttgagtgcagtggtgcaatcttggctcactacaacctctgcctgccaggctcaagccatcctcccagctcagcctcctgagtagttgggaatacaggcatgtgccaccacacctggctaatttttgtatattttgtggagacagggtttcaccatgatgcctgggctggtttcgaactcctgagctcaagtaatccactcagctcggcctctccaagggctgggattacaggtgtgagccaccacaaccggccttacatgcttatttttaatgcttttgttatatgttcccaaattgccctccagaaagaatgtacccacttctactcccaaaagcagagcgcccaagacataatttcatctttaagccaaaacttcaaataaaaaatgtattccatgtatcatcaaagtttaaattttagtgaatgtaggagcacttgtcaaaatgtaagatgcaaaaattcaaagagaaaagaagaatataacatgctacctttttggaagatgtcatgacactaatattacaatatttctattaaaatattaatttttaccctctctccaactgtattaatcattccacaattgtgaaggatgtactatctcaaagggagagagagacatggttcaactgtataagctttttggagtaataagaagttgaacacaataacttcatatttcaactgtgagggttttcttttaaatctggttataaataatttgatatggcacccccttagaattcatgaagggatggctctgcagggctagtgaagctgcatggtaagtctgttgcatagaagtctatagagcaggctcttcccagaaaggaacaacgcgcctctgatcgttgccaattgactcttctctgcctttctctgccctattcattgtgccatcagtattcacttattgtcaacaacatgctgatgttacccagccctttcttctgacctcattctgaaccttataaagtgtgatccagcttaatcaactcagagattaagagctgtagtctatacttgtttttggaatggatcctggcattatttatttttatttttattttaagatggagtctcactgtcactgggctggagtacagtgccatgatcttggctcactgcaacctctgcctcctgggttgaagggattctcctgcctcagcctcctaaatagctgggattacagccacacaccaccacacccggctaatttttgtatttttagtaaagacaggatttcaccatgttggccaggctggtctccaactcctggcctcaagtgatctacccacctcgacttcccaaaatgctaggattacaggcatgagccaccgcacccggccggattctgtcattattaacattattaacattttcactcatctcaaagaactcacagtggcatgtacagaccttgttgatcttcaggtatgggctggtggtaagggacataatttggatatgctaaggcacagaaaaatgagacgtgaaggaagatatttatgtgtggtacagtttgcatttaataggttgagcatccctttttaactgctaaagcactagaactgcaacatgcctaacctgcatgttcaccatgggaaatgcacaacagcaggctgcaacatgctcctagataccaggacttcagagcaccatggatattcggcttctgcaggctctggaaatagtgtctagtgggctgtgaatacacctggagcagaggagagagaggaaagctgcaggcctcagtgctccttgctgtgcccacacaagtgctggacgtccttcaagactcacagggaacacgttaagagttgaactaaattgtgtctcataaatgttcttcagtcgagcctctgggaaatctgtgttggttaattttatgtgtcaacttgactgggcacccagacatttggttaaacatttttctggatatttctgcggggtattttctggatgaaattaacatttaaatgggtagaccttaagtaaagcagactgctcttcataacgtaggtgggcctcatccaaccagatgacggcctgaatagatcaaagaatgacctcccctgagcaggagggagttctgccagcagactgctttcagacttgaacggtaacccttccctgagtctccagcctgccaggctactctgcagatcttggacttgtcagcctccataatcaagtgatccaattccttaaaataaatctgtctctctaggtgaataacagttgacccttgaacatcatggggttaggagcaccaactccccatgcagtctaaaatccaagtatagcttttaactcccccaaaacttaactactaataacctactgttgactggaagatgtaccaataacataaatagtcaatgaacacatattttatatgtattaggcactgtattcttacaataaagcaaactacagaaaataaaattttacttaaaaatcatgacgaagagaaatatatctactaattaagtgtaagtgggtcatcataaaggtcttcatcctcatctttgcattgagtaggctgaggaggaggaggaagaagaggggttggtcttgctgtctcaggggtggcagaggtggaagaggtagaggggatggaaggggaggcaggagaggcaggcatgctccatgtaacttttatcaaaaaaaactccatgtacaaatggacctgtgcagttcaaacccatgttgttcaggggtcacctatatgtgtgtgtgtgtgtgtacacacatgcatgcacatatacatcttactggttcagtttccctggagtaccttaatatgtctgctctgcacttttcagtggaggatattcttaaatgcaaagaacaagctaccttttggaggcctaagtaagagctgctgtcctcaggaagcaaactcagaatcgaggacaacagccagacagaatcctaaacctctactccctcaggaagggaacaatcttggatgagtgaaatccccaaagttggtgtgtcaagaattgcatgtggataaaatatgtgaggaaaccactagatgaagccccctggctactccatcagtgagtgaaaacaggtagaccaagcataataagagggacttttatagactttctcctcaatcccacagttaaaattgtcaaagaagtgaacaaataaattagagctgagcagaaaatctttaggagctgttatggactgaatatttgcatcccctctccctgctccagattcatactgatgccctaatcccaatgggatagcattaggaggtggagcctttgggaaatgataaggtcacaagggtggagccctcatgaatggggttagtgccctaataagaaaaggccagagagagctttcctctataaaccaggaagagggccttcaccaggaacctgacccagctagcacactaaactcaacttccagcttccagacagaactgtgagaaatcaacacttgttgttgaagccacccagtttacagtaatttgttacagcagcctgaactatgacaggagctgtgtacatttgagaggtgaagccaactggacttcctgggtcgagtggggacttggagaacttttctgtctagctagaggattgtaaatgcaccaatcagtgctctgtgtctagctaaaggattgtaaatgtatcaatcagcactctgtaaaaacacaccaatcattgctctatgtctagctaaaggattgtaaatgcaccagtcagcactctgtaaaaacacaccaatcattgctctgtgtccagctaaaggattgtaaatgcgccagtcagcactctgtaaaatggaccaatcagcactctgtaaaatggaccaatcagcaggaagtgggtggggccaaataagggaataaaagctggccaccccagccagcagtggcaccccattcgggtccccttccacactgtggaagctttgttctttcgcttttcacaataaatcttgctgttgctcactctttgggtccaaaccacctgtaagagctgtaacactggctgcagaggtctgcagcttcattcttgaagtcagcgagaccacaaacccaccagaaggaagaaactccagacacaccatctttaagagctgtaacactcaccgtgaaggtctgcggcttcatttttgaaggcagtgagaccaagaacccaccagaaggaaccaattccagacacacatttagcttcctgattaaaacttggcataaatatttagcataaagaagactaaaagcataaagatatatgctcccattcccaaagcaataaaaggaccaaaggagtgtgcatgagagtgagtgtgtgtgtgtgtgtgcgttctctccaaagcaccaagcagtggctgttgatggcagtataaaagaataattttctcttcaggatgttcaaaagcaaacctggcagcatgaattagatggcctaattttaaacatacaaaacacctctagttcttaatgaacaaataagcaaagtgcaccatcggtggcctagacaccatttcagttttacactggaatcaataagttaggaatgatttgactcccagagctagcctcaagtccaagccatggagaatattaaactgacctcccctcatgactctggccaaccctgtgttccagcccttcactctctccataggagagggctgaacccccaccatgctctaaccgaaagcacagctggccttccctcttctcctcagctttattgaggttataactgacaaacaaatattgtatatatttaaggcatacaataggaagttttaatatacctatatgttgtgaaatgataatcaagctaattaacatatccataacatatagttaccttttttgtgtgtgagagaacaattaagatctattctttgggcaaatttcaagtatacaatagagtatagttaagtatagtcaccgggctatacactagatctccagagcttattcatcctacacatctgaagcttttaccctttcatcaacatctccccatttccctcacttcccatccctgacaacaacctgtattagtctgttctcatgctgccaacaaagacatagccgagactgggtaatttataaagaaaaagaggtttaatggactcacagttccacgtggctggggaggcctcacaatcatggcagcaggcaagagagaaaatgagagccaacaacagggggagccccttagaaaatcatcaaatctcgtgagacttattcactaccatgaaaacagtatgggagaaaccactcccatgattcaattatctcccacctggtccctcccacaacatgtgggaattatgggagctataattcaaaatgagatttgggtggggatacaaccaaaccatatcactaccattctgctctctgcttctaagagtttgatgtttttagaacccatatataagtgagatcatgcagattttgtctgtctatgcctggcttatctcacttagcataatgtcatccagagtcatccatcctgttgcaaatgacagaatctccttgcttttaaggatgaataatatcccattgtgtaccacattttctttgtccattcaaccgtttatggacacttagcttgtttccttttcttggctattagaataatgctgcagtaaacattgctcttcactttgtaaatatattttcattttaaaaaatcattcagataggcaaacggaacaaaagcagaatagcacaatgcaccactctgtgacaaccccattaacatttggtgacgatccttccagacttttctaccactgccatcctcacacagtgatttttagtttcttttttttctaaataattgttcttttatagattttaaaagaatttggcactttgggaggctgaggcgggcagatcacgaggtcagcagatagagaccatcctggctaacatggtgaaaccccatctctactaaaaatacaaaaaaaaattagctgggcgtggtggcgggcacctgcagtcccagctactcaggaggctgaggcaggagaatggcgtgaacccgggaggcggagcttgcagtgaacggagatcgcaccactgcactccagcctgggtgacagagcaagactccgtctcaaataaataaataaattaattaattaaaaataaataaaagaatttggaaatgttcatctctctgagcatttattttcattgtttataaaaagtggatggtgttcataatacctctctctgatcaggctgtcggaaaaattaaagaagttagtgcctctagtacataaaaagtaagttgtcctttctagtcaccatctgttcctcctttctactttccttcctttttgacttattccttgaacaaatgtttattaagcacctactgtatgcctggccctgcactaggcaccaggctcacaaggatggggaagaagacagccatggatcttgcagtcacggtacttatgcagagacaaagacagagacagagagagagagagagagaaaggagagagaggagagagagagaatgagaacaggcttgcagaaactcctggcaagaccaccaaacctgcgagagtgagggagggtgtcccaagcagagggcacagcattacaaaagccaaatcatcacaatgtggcgcactaggtgcaagaagggaagagttcatgagggacaaggctgcagattgagcagagaccatgtcaggaaagtcctcatgtttcagcttaaggaagctgaaggcagcccaaagttcgctatcttgtaggtattattgtctccctcactctgcccttgctgggtctcccactgtttccatagcctcagcccctacttctgaggctctgctgagggtgccttcactgttccatagccccagcccccacttctgaggctctgctgagggtgccttcactgttccatagccccagcccctacttctgaggctctgctgagggtgccttcactgttccatagccccagcccccacttctgaggctctgctgagggtgccttcactgttccatagccccagcccctacttctgaggctctgctgagggtgccttcactgttccatagccccagcccccacttctgaggctctgctgagggtgccttcactgttccatagccctccctgctgtccccctcatcccatgaattttgcccctttctctcaccatcatgttcttctgttgcctctgccatttccagttgattctgtggtggggaaggacacggaccttcctccagcaggtattgccatagttctcggcttactttccctgccagactctttgggagagtggcctgagctcccagcctccacctgctctttttccatttaatccttaactattgcacctgcgttcagtcatcagccctcaacactcagctgcgaggagctggtgaacttgtgattacacccagcaggcatctggccagtccttcgcttgcttggcctctttgtagctttctgaccccctcctctcctttcttggttcacccctttccctcagcttctaggtacctcattctccttgtgtcctcctttttttcttcattttcctcagtcatctttataaatctttctcgtctactagcccttcaacgtgtggctgtcctttcctctcctcgctgcactctctccgaaatctgtatctccagaccacatctgctcatgcagacaaatcctctgacttccagccactgtgagcctgccaccccaggtccccacctttctgtgactcagtgaggcttcccaagtcaggctcattgcaaggaaaacctggtttaactagtaaagaggtgggttataaaatattgttagaaacaccgtggtggtttaaataatgtctgccaaaatgatgtgctcgagacctaagccctgggacctgtgaatgtcactttatttggaaataaagtctttgaaaatacagttaggttgggtgcggtggctcatgcctataatcccagcactttgggaggccaagggggcatggattgcttgagtccaggagttcaacgccagcctgggaaacatagcaaaaaccccatctctactaaaaatacaaaaaattagctgggcatggtggtgcatgcctgtagtcccagctactcaggaagctgaggtaggaggattgcctgagcctgggaggtcgaggctgcagtgagccaagatcacgccactgcactgcagctagggtgacagagaccccatttcaaaaaaaggagggaagggaaggagaggagaggggaggggaggtgggggaaagaaagaaagaaagaaaaggagaggagaggaggggagggaagaggaggggaggggaaagttaaggatcttaaaatgatacagtcctggatttagggtgggcacaaaatctgactggtgtcctcataagacaaaggcctcagaaaactggagagacacaaggaagaaagccatgtgaagacaaaggcagagattgcagtgatactgtcacaagccaaagacttcctggagccaccagaagctggaagacaggatgggttctaccctagaacctctggggatagcatggccctgcctataccttgatttcagacttctggcctccacaacggtgagagaataaattactgctgttttaagccactcaatttatggtaatttgtgacagcagccctagaaaactaatacaggtacatacccattattctctttttaaaaattgctcatacaattttcaagtgggggtcctggctttcataactattagagttattgatgaactactgtttgctttatacctgtaaaatgaatggtgttggttgtgcataagtgaagtaaacattttctttctgttttgtttatgttgttgcttggtgaactcatttatcaaagtgaaggcaaaaataaacattagtacatcttaatccaaagccaaatttgcaagacttggaattaataagatgctgctgaaaagtggtgcaatccttgttatttttatagactgtgattcttgtgtttggctaatgtaattaatcttcagctaaaatcatctgttccaaatttacactaattttcaatgcttcaatatgtttgcaaagcagcattctgcttctgtgtactgcaggtagattcttgttacctgttagccttggtagagcttatcaactgatgcagtgcacaactttggtggtgctggggcatttgtagtttttttgttgtttgtttgttttgttttttctttgagatggagtttcgctcttgttgcccaggctggagtgcagtggcacaatctcagctcactgcaacctccacctcccaggttccagtgattctcctgcctcagcctcctgagtagctgggattacaggtgcctgccacaatgcccggctaattttttgtatttttagtagagatggggtttcatcttgttggccaggctggtctcgaactcctgatctcaggtgatccacccactttggcctttcaaagtgctgggattacaggggtgagccactgcacctggccagcatttgtttttgatctggggggatacttgctactggcattcaatgggcaggtggcagagttgtcccacccaaaatgcccataagcaaccctctgaaaaatattgctaaggatttccaatacaacatttgtgacttgtcaaggtgatgccatttattattaggtgtgtgaaaaataagaaatgacttgtattggcttattttctttgtatccaaggcaccttctgcataactccctcctacctcttctcattggactgtgtgtgttcacatgttcatcttcctctagtctctttgtcacatcagaacggagacggcacttcatttgtctttgtatccccagcagcatttcagcaacagagtggatgctcagttaggcttgatgactgaaaaacgaacaaaagcctggtacaccaaaaaagtttagaaaatgtttataagaacaaattgtctcttttgtcacagaaatactctttgttatcctgaaggccctggtttggtcttggggaaagcacactagatctggtatcctggtctagggttcttgacacacgcattttatcattatcttactaggtcttagatttttcatctggaaaataaggggaattagggcttggtctgcattattctaaggtctctttcagcttcaaaaattctacttctttgttagacaaagataatattacctccagattagacaccatagtcctactgccaagtgcaggctatttctagattttctactaatcctctaacatcagtcattatcttatttaatgtcagagtctagatttggccgaaagtccgtttgtagaagctacattttagaaaaacaaatgtacctagcttgagaatgtaagccatctggtcatctgttatcctggtttccatgggagcatattttccttttcggccatggaggaagaccgggaggataccaacagccattctacataatcagagttgaaagagagtgagtatggcacaaaagtggggagaagagaaaatggcaaacatgatgggacatcactttgtgagtttgtataaaaaactttggtttccatcttgctagccaacactattgtcttctcagcttgaacaatttgataaagcaagctgccttgttgaagagacccacgtggcaagaaattgagagcagtcttcaaccaacagccagcaaggaactaaggccctcagtccagcaatccacaaggaaccaaatcttggaaacatccatgtgagcttggaagtgaattatctccagctgagccttaagattactacagcccagctgacttgactgaagcttgttagaaatgctggagttgagaaccagctcagccctgcctggattcctgatccacagaaactgtgagataatacatgtattttaagctgctaaatttgggggtaatttgttacacagcaatatataactaatatacttgatattcagaaatcacgtatagtttgttatctgccaccatggatatctaaacaccagtgactatcttttgtttctccccctggtgtttacttaatcgcttaaaactccatctggtcatctagccccagctcttcgtttctaaataccattctccattaaaacaacctaggctcttggggaaagttgattccagggttggggcagaaaaaggcaaaagcagagcctgaaacattttttgatgcaagaaagtaaggagtcctccctaaaatgatgaggcaagtcaaaaggatacagaaagcaacttgaagagcccccagtggtaaaatctgaaacaatgtgaacaagaatttaaataatgattgtaatagattataacccatagaataaaataaataattatgagttcatacttatataaataaacacataaaaaaattaatgtgtgagaagggacagcagaatttaattagtaaatatagaaagaatgatgcaaatagaaagtaactattagacaaattccacagtaatcattatggattacactgttgcatgacaaaagagtgtatttacatagtctcaaaatatcttcttataagatatttattgcttataaagagaaaaataatttttaaaaagtggggaaatctgtaggataccgccttaaactagtgatcaaatttagcatcaccatgataagatatatcaatatcatgtacatcctgttattcactaaaaagggcacagcatcactttggcagtgttcttgccaaaaatgtttagcttcaatctattaatatttattttaaaaatcaggctgatgcacattgagagtttttactattatcttactctattgagctctttgagtcttggtttctttatctggaaaataaggatgttggactggctagtattcttcaaaagtgttcaagtcataaaagacaaagactaagaactgcacagaccaaggagaatatggagacacaactacatggcatgccatgcttaatcagaaaagggacattagaaggaaaactggcaaaactcaaataagatctccgaatgagtaaatatcattgtatcaatgctaatttcctacctttgataattatactagggttatgtaaagtattgacataaggaaaagctgggggtaaaaagtaaagagaaagtctcgctactcttttttggaacttttctacaagtctaaagttatttcaaaataaaaagtttgataataaaaaacatctggtattctaagaggatattctggtagcctttcaatctcacaccacaagcgaacaggtgcaacacctttgatgtgggctatcaaagaacagcttgcttttgaacaacagttggagtttgcatttctggtatattgactttttttttttttttgagacagtgtctttctctgttgcccaggctggaatgcagtggcatggtcttggctcactgcaagctctgcctcctgggttcacgccattctcctgcctcagcctcccaagtagctgggactataagcgcccaccaccatgcccggctaatttttggtatttttagtagagatgggatttcaacgtgttagccaggatggtctcgatctcctgacctcgtgatccacctgcctcggcctcccaaagtgctgggattataggcgtgagccaccgcgccccgccgtatattgactattttttatctaaactcttagaagatattagctcagttttaattaatcacttctaactttatagagtcaagagtctacatgttttagtctctatccttcacttcattcatgatagaagaaattgctcatccaaatctttagcaaagataaaaatgtgcacatgaaagggccttatatactgctctttagtcacatttttataagtttacattgtttactatggcatacataggcaaacctcagttatctgcaaagatcatagcatgctacatttcatgatgctgttagtaaaaagtgataactagtaattattatgtattacgttggtggtagaaactgtctatcattgccctaattgtttgtcataataactaacatttgattcctactacatatgaagcactgagcagaccactttatagattatttattttattccttcaataacactatgagttaggcacagatgagtctgcaaacacatattcgctagtaatatctggcatcagagaaagagctaggtgggttatactggaccccaagaaaggtctgtgctggagcagtgactgagttgtcacagcaacaggcactatttgatcaattcccttctatttatgtcttttcaatcagtttactctgttagcactggggaaaggggagtaggcatggagggaaagaggaagagaggaaagaaagaaagaaggaaaagaaatctcaaattgtctgaagagtctcaaccttgtcataaaaatgaaactttcagtttgatgtgtttcaaattagagaagtttccaattggaggagaaagactcaggaggaatatgaaagacagttttttaaatgtgaagggctgttctgggaaagggggattcgaattgttgtgtgtggcctgagaaagaagaatagggggccactgggtggaagtttacacagacacattttagctcattataaagaaacactttctaaccagatagtccaattacaggagatgctgcctcagaactttctgagctcttggtcccatgagtgctacagaggagggtggatgaccaactctcagagaagaagaataaaaacaggggattggtacttaaattaaacgactttgaaagtctcttctagtcaggatgctctgtgaggaattctgagcctttgctttgccactgaatcagacactactgagagaggtcagtttccaagccactgaatcagaccctactgagagaggtcagtttccaactccctcctccatggtgtcttagctctgggctacctattatgttgagttgagagaagcaaactgaatgggtatttggaaataagaggctgaatcagacaaccagtgcattgctgtcagtctttcagagctgagagaaaactatgagatctaaaatttggaagactcttaactttgtgaacttttctcctttttctgtaagtgggaggccatgcagtatggtgggtaggatgtcagctgtggagagcctgcctgggtataaatcctgggtccccatctcctggctgtggcagtcattggtgctgttctctcaaatatttccatatcttttctcctgggaagtactgacatctccccccacaccatcaccccctccccacacacacacagaggagtgtgaccatgtgacacattctggccagtaaaataaaagaagtaaagccagtgtgtgattttcagcctggccctaaagtggggacaatgtggagcacagccccttgccaaccataatggatatgcagtgtgagtgagaaataaatccttgtcttaagctacttagattttaggagtgttatctcagcataacttagcctaccctgactgatacatgggctctgggccagttacttgacactgctaaatctcagacttattatacataaaatggaatcataatagcacccatcttctagaagtgctgtgagaatcaagtgagagagttaatacatacaaagtcttaacacagtgcctggcttataagtaagtgctcaaaaatgttatctactatgatcactataccataagctccactgggtcaggaatcatgtgcccagcactcaatagcaatttgttgctattggccaggcactcaatagcaatttgttgaagaatcaaattaagtcattcttgacaaggagcatcaatgacacctaccacactattgctaatctgatgaatgatattcagttgtaatcttactcattggcagcatcctccttgaaactccccctttgttttctaagatattcctcctggctggtttcctcctagatctctgtcctctcctcaatctcttttccagtttctctttctactccctaactatcaagggcattctctagagttatgtctttggccctcttcacatcagagtcactggatggctctacaaagtcctaaggcccaggtcccacctgcaggtttcctgatataattggactagggtgcatcatgggtatcgggatatttaaaccaccctcctaccaccaagtgatcatcctgtgtagccaaagtggagagttaatgccctgcacctgaactgtccaccacagtgaccacataagacaattaagcacttgcattgtggtgagtccaaactgaggtgtgctgtcagtgtaaaatacatacaaggtttaaaagactagtatgaagaaaagcatgtgaagtgactcattcttaattttcatactgagcacatgttgaaacaatgatactttggatgtagtgggttaaatatattattcaaattaattttacctgtttctttttactttctgatgtggttatcaggaaattttaaattatatatgtggcttatgttatatttctagcagacagagctgctttagacactcctgctgagtggtgccatctttctcatggcttttaccactgtacattatgatccacaaataggcttctccagcacctacttctttttgagctccaagctcacgcatccaacccaaacacacatcttccacaaaattggctcttcctctcctggtgctgcctgtggagcatcaacatctacttgtccactagacaaaagcctgcaattccttccacttctccacatcttcccccaaccatgtgaaccacctcctgcacattctacttcctaaatatttctcaaaactctgcattgctcttcatccccactgtttctgtcctcactggctttcagtggtctatcttccatctaatttattgtagacacctagcaagagatggatcatttcaaaatgcaaatctcctctgtttaaaaatgctttcatggcatcagtggacttgaggataaaacccaaagtcctaacaatgtctatcaggcctttcttgataaggtgcttatctgtctctccgccattcccacctgagaaatggggactgccctgcccctccagctacattgaactgctgattcctccaatacaccctgctctctcaggaccctggatctttgcacaaactgctctcttcctggaaggctgttcgtgttcccctgcacctacataactttctctctctctctctttttttttttttttgagatggagtctcactctgtcacccaggctgcagtgcagtggcatgatcttggcttactgcaacctccacctcctgggtccaagtgattcttgtgcctcagcctcccaagtagctgggactacaggtgtgtgccaccacacctggctaatttgtgtattttttgtagagatggggtttcaccatgttggccaggctggtctcaaactcctgacctcaagtgatccacttgccttgccctcccaaagtgctaggattacaggcgtgagccaccgcatccggcctcataactttcatcattcaggactcccagcttgctctccatgaaaacttccccagccaccccttctctcaggctaaaggagaaactctttctcaccccactccatgttctcataccataggtgtgttgtctcctcccactatacacctcaatgcccagcattgtcagtgtgtgtgtgtgtgtgtgtgtgtgtgtgtgtgtgtgtgtgtgtttgtgttttaagagatgggggtcttgctctgtcgctcaggctggagagcaatggtgcaatcatagctcactgcagcctccaactctggggctcaagcaatacttccacctccacctcctgagtagctgggaccacaagtgcatgataccacacctggttttttattgcccttttactttgtctactcccactagaccataaggcttttaaaggaagtagccattcctgacttgcctttgtatccctagtgcctcacccagtactggatacagcataataataacaacagcaacgataataacaatgttaataatagcagcagggattgagcagttactacatgtcagaaactgctctctgcttcacatggattgcctcttttaataataactttatagaagtatattgagataataaaatttgagcgtggcctaggactgtgctaaacaccacaagacacactaagaagcagattctctaatctaaagaaattggaaatatcatcaagtaacaaaaatagtgcacaattctttcaggcaaaactaccacccaaagaaagacattcaaataacttctaatttattaaaggaagagttgttcttgccatttaaaaataaaaatatgtcaataggaattataattattatggacagttgagaagccagaagtgggaaaaaacgacaaactatttagtgaaacacatgtagtatggcatggctttgttcaccaaaacattgactcagtatggaatgtttctattcaatcttcaataatccctgttagttcatcaattcaacaaatctatgtaatatttataatacaacatgccaatggtttcatatatatatatatacacacacacacatatatacatacacacacacacaccccatgtgtatttatgtgaaaatacacaggagctagaagagaaacacatgaaagatttaaaacaacaaagccaaactaagtatccagacccatgagaacttcagagtaggaagagattagtgtggatcattgtagccagaggagccttcatgcaggtaacaagatttgaagaggaagctgtgggaggctgaatatacagaaggtagaaagaagggctttccaggcagcagaaatagcatgagcaaaagtttgggtgaggccatgaactttttcagagaacgtgccattctgttaagtcaaagtcttacccatgtatttaaagacacaaagggctggtttcttcatttctcctgattcacgtctgtgcttttgtgtcacttgtgatgctgggtgaaagaaggtgcctctctgatgtgtgctagtcattcccaaggcgacagctctgtcagagataaaaataaggaagtatccttttttatctcctttgagatgctaacaggctgctttccagattgcattccagtctacagttggttagcagatttgtgtactggttccacctgggcatataaattactctctccactcaaagtgctttgtagagcacaagaatttatcgtgtggagaggtaactatggtctgctacagttttatcggtgtctgtggaataatcctgagcttagagtaaattttagcacaccaagcaatttatataacaaccaacctccaattatctaattttcagaaacaatatatgaaacaatgggcagcatttgttaggcacttactatgcctctgagatttggtggggaatgttctgtgacagggagacaaaacaagcaggaagcagccagaggtccacacactagggctaggcaggctgtaaagactctactcagttcccagagagttaggctgggagatggcctttagataaagatagataccgctgggcacggtgggtcacgcctgtaatctcagcactttgggaggccaaggtgggtggatcacttgagatcagaagttcgagactagcctgaccaacatggtgaaatctcgtctctgctaaaatacaaaaattagccaggcatggtggcaggcgcctgtattctcagctattgagggaggctgaggcaagagaatcacttaaacccaggaggcagaggttgcagtaagccaagatcgtgccattgcactccagtctgggcaacaagagcaaaactctgtctcaaaaaaaaaaaaaaaaaaaaaaaagatagatacctatctcttttcttgatttagatgtaaaaggtcagggattggcgacggggcaaccagaaccctgagactaggatcatgggctgggcacttgggctttccagagatggaaagcaaaagccatcgacacttagctctaagacctagctgcctactgtgccgggaacatcaccacttccatcctaatgaaatacggaaagagcacagatgtgatgtcgtaacaacagtccaaggaaggggaggtggcaaaatatgaatttcctcacagagaaaggggaggtggccaaaccaccaaaacgggggtgggcatcaatggggttcactacatttgacttcatgcagcctgtctgaaccccttcctcttgtttcccttcctgccctgaaaggctatactgaccattgcagagtctgagaggagtaagcaaagttagcagctagtaagcaaagtgagcagccttggctgggctgagtcactggaaggttctgagtgttcagaggctgctgcagcacagggtaagacgtgtggcccagactccagggcagtgtcagaagaggctgcacttacatgcaaaagctaaacaggagttaaccaggcagagtggggagcacgtgggcaaagggaccagcaggaagaaaggcagggatgtgagaaaggctgggcctttcggttccctcaatatggctgcagggcaaggcgggaagggggaagacaaaagatggacgtggagacctagcctcgcatggcaggcaaaggaacctgcaaattagactgcagacagtgaggagctcggcagatgtagcataattacagctgtattttacaaagactactctgatgacaggatggaaaaagttaactaggtttgttcggactgaatgtttgtaccccctacttcttgcccaaatgcatatgctgaaaactctaaaccccaatgtgatggtattaggaggtgaggcctttgtgagataattaggtcatgagggtagagctctcaggaataggattagtgcccttagaaaagagactgcagaaaaatctctagccctctctctaccatgtgagaacacaacaagaagatggcagtctatgaaccaggaagaggaccctgggcagaacccaacgatgttggtgtcttgatcttggacttccagcctccaaaactgtaagaaataaatgtctgttgtttataagcctcctagtctatggtactctgctgtagcagccccaactgactaagacaagagttcaagggggatacagaaggcagtaaaattagtccagaaactgctgcaataacccaagtactaaataaacaaggttctaaaccaaattggcaacagtgggaatgaagaggatgggatagattcaaactgcaacacagacgtacaaaagaatacacagaatttggaaaccaattggatgcggaaggtgaggaacaggagaagtaaagtaaacaccatggttaaggcttagctaactgagtagctggtaatgccacttaccaaatactgaatcagtacttgtcagtgccaagctgctatgtgtattccaagcatcatgggttctgatacaaggaagtagaggcttacaaaacctcaagaagggcttggagtggttttcagaagtgctacagctgctgttcagaaaaagagaagcttctttgaatctcaagaacttctagaaagcttggacctcagcttacagtagcaatgcaggtcatctccaagaagccactgcagctgtctacactgcctacagcactgtaacaaatactcacctgggagttcagctagagaatggaaagttgagttggggtaggcgacgtgatctccaaggaaggtgtttgatacacacatccagataacaaggaagagctctgaactagaaggacagatttgaaagccatggggcttaaaaatggaatcacccagagagaacatatgcagaaaagtgagaaagaacaggacagtatccacaggagtccaaataagacaaagataagcagcaactcaagccccgcccccacccccacccaccgtctaactttaggagctcctcacctcttatggtgaggagccagactcagctgatcccagtgcaagccctcagcctcatgttctctagcgcatgaccggagctgtatatggaagaggtggcatatggattgagtgtgcctggcagatattgtaagcctgaattttctccaagtaggaaaagatgatggccaagtgcaggtgggtagggaggaaaacttctggaagaattaaggcttgaggaggaaagatacaaatcaggtaggctattttctacattaaatttcaatccttgctataactgctgcccagaaaagaaatacatctggtgaaagtcacatggttcaagctaagtgaaatcaacaatttttctttgtgctaaagatttcacggtttgtctcatttgcaatgggggaaaaaactttttaagagaataaatcattaggagacaacctgctatggtttggatatttgtcccatccaaaactcacgttgaaatttaatccccaatgtgacattactgaaagggagggtctttaagaggttgtcaggtcataagagctctgccttcatgaatggattaattcatttatgaatgaatggattcatgggttatcatgggaatgagactggtggctttattagaagaggaacagatacttgagtccaccccccctcaccatgtgatgccctgtgccaccttgggcctctgcagtgagttcccaccaccaagaaggtcctcaccaaatgtagcctctcaaccttggacttctcagcccccataactgtaaaaaataaattccttttctttataaattacccagtttcaggtattctgttataagcaacagaaaatagactgagacacaaccacatttcctaaccaagtaatttacaagattattcaaggaaagtcaaaaccaatttcaaaagcgtgttctaagaaacaagtttgtacaaagatacattattgcaaataatgcacctcaaggcatactaattatgtagtttctaaaatttccccccaaatatggtcatttcctaaatataagagggtaagcgaagtaagggattgaggagaattatataggttggaaatgattttctaacaatttctcttccaccctttttattccacccaacaacatcgtttcatttctgtctcctaacatctaatcacttttactcactatccaaagactgacaattaacctcaacaatttttgccattttccaatgaggcttcaaggtccatgttgacactcacccaatatcctggaccctcatcttcttgacttcatctctagtgaattcctctttttctctacctcagataccaccctcatgatctcattcttgactctcatcacctgaaactgtgtcattttcaaaaatgagacttctaaaatttataacatgtaaatatccacctctgtgaccacaccctcacatccttccacttcccttgatcaagcattctgtaacaggctgaataatgacacccaaagacagcaagtcctaagtcctgtaaatgttgccttgtatggcaaagactttgaatattcaattaaattctggatcttgagatggggagagtatccttggattatcccagtgggccctagatcaaatcacaagtgtccttatatgagatatacagagagagatttaacacggacagaagacaggaagtcaatgtgaaggcagaggcaaagatcggaatgatgcaaccacaagccaaagcatgctagtagcaaaatacgttgactaattaattaaatttaaaaattttttaaagaatgctggtagccaccagaagttggaagaggcaaggaatgaattctccccactacagcctcaaaggaaagcatggtccccactgatttcaccccattgaagatgatttcagggccaggcacagtggctcacacctctaatcccagcactttgagcagctgaggtgggacgatcacttgagtccaggagttcaagaccagtctgggcaataaagaaaagaaaagaaaagaaggaaggaaggaaggagaagggaaacgaagggaaggaaggaaggaaggaaggaaggaaggaaggaaggaaggaaggaatgaaggaaggaaggaagaaagaaagaaagtccaaccattggccatctttgtgtcagcaactggcaactaagtgttgttaaaaaaaaacaattatacaaccaggcagattgataccacccaaaattgatatctgggaacctcagttgaaccctccacactgcttaccctcagccatgttctagactatatgtatatcactgtcaactcaacatggaagtcacagaggcactttaaatccaatgtatccaaaacttttctcatgatctcactctccaaacttacatctacatgttccacagctcagaaaatactggccctaatactgtccagttattcatgtcagaatccttgacgtttttcttctctcatccccttgatgaatccatcatcaaattctgttgattttagtgcctcaaagtttctcaaacctggtcacatttctccactttttaccaatgtaatattcaattcactgtcatcaattgtctgacctgggacaatagcctctgcacacgtctctgcatccattcttgctttcctcctgttggttcatttgttatgaccagagttattgtttaaaatacaagtttaatcattttggctctctgcttaaaactgaatatctgaatatattccagttcttcatagaataatgtcccaaatccttagcatggactccagctctgcttcatgatttggcctcttctctcttcggcctcattttgatttgtgcttcttcttaatccctttaagttgcagtcttgctggccttatctcaattcttagaatgcaccaagttctttccagccccaagacctttgcctacactcttctatttgaatggattgttctttcttccttgccccacccaccattgccccctccgcctaacctggttatttcttattcctcctttaagttccagcacaaatgtcatcttctcatggaaatctctaccacctccctgcctaggtcacatctgctaatgatatcctgctaaagccccctatactttaccttcacggcacatacccaagtgaaattgtgaactacttgggtagttatttgattcatttaatgtatctcactttcctaggttataatttttataaggtctggagccttatccatctcattcctggtgactctccagcacctagaacagtgcttgggccctagtaggtaagcgagtgcttattcaattttggatggaatggaaaacttaggagcttgggagttataaaagatgagcaaaacctggttttgtacccaaggagtttgcatttggatacttgttcaaatctcatgtcatctaaccccatctcagaaaaaagaaatgactgtatatcaagaagcatattgagatgagtacctaagcaatttaaaaggggttatttcagcatggccactgtaaagttatatggggtttgcactgcacaaggaaacattgtcaggaggtgggttaggagcttcaatccaaccatgctcagctttcccagctacacattggtagggactgcatctgctgaagatgtcctttttctatcttgagaaaaggtatggtagaggccagtggttgccttgattcacatcccaaacatgtgggtcctgggtgattttggtggtgcttaaagaaatgcaatagcctaaaattcagacaggtagtagtagaaccaagaaaaagccccaggcttgagacatgtccattattctattcaaacagttaactatgagggagaactgaggagaaggtctaaatacatattgagttctaaggtggcaattaaggacatctaatagaatctttaagtggtccctatctgactctaagatgtctctctgaggtcaagaagggtcaaacagagcctcaaaacacaaatcttgctatttaacattctcaataatctcaatgttagctcctcaatagctttcagatattataccacttgctgcaaaattaaaattagagtcaatacaatgagtactcagtatgcaaaacaattcaaggctctatttcagcatgaagttccatttaagctgcaggaataaaaggaaaagacaaccctttgttctctttatttcacaatcctgcaaatggtctcttagccaaaatagttcctctaatctttaagttttaattagctgcccacaattcataaaatatcaggaattaaaattctgatacctcattctcctgagaaatggcacacaattaacctcttttttctggtcaaaggcagaaattgagaaagggtaatgacaaaattaatctattctggtggcgaggcctgccataaggctggaagacagcatccgaccctgcgtcgaaggggaaagcaatctctagcacgttgaggagcctcagatcagttgtggcttttgtattcatggtgaattctatcacaaaacatgtgagccccaaatatcttacaaaaatattaaatgattccccaggaagaatcaacctagcctgccttcctttctctctaaaaagaggtaaatacagaggctttaagtggtcagaagctctggctttctagcaaggtgggtagagaaaaaaaaggactgagaaactcacaccttcctggcatcatctccagatcaaaacatatgctgggcagtagtaaagtcagatggagtttctgggaccaagtttatacctttctataataattagtccccagaaaatatagattctgcttttattccctaatggtaaatcacacggtaaatatttaagcagaattatccgtatccatttaaactcagttgaaagctcatgggacagaatacagcccagtactaagaaggtaaagatatttcaatggaggctgtcaatgaagacaaaggcaggcctaactagcccacatttagaaggtaaagatgtttcaacagtggctctcaatgaagacacaggcagacctgggtaataggatggaggctgtggagtccatctgcctggtttcaaatgccagcttggcaacttactagttgtgtgatccagggcaacttgcttaacccctctgagtttctgctacatatctctaaaacagggacaaaaacctgtgttgtaaggataaaagagagaatgcgtataacatgcttagctcagtacctggcacttcatgagtgcttgttaaagttagttactattattgtcaatagaggaacctaaatatttttaatgagtttaaaaaagaaagatacattttcatgttaagaaccctttagtggccgggcacggtggctcacgcctgtaatcccagcactttgggaggccgaggtgggcggatcacctgaggtcaggagttcgagaccagcctaccaatggggtgaacccccgtctttgctaaaaatacaaaaattagccaggcgtggtggcctgtgcctgtagtcccagctactcgagaggctgaagcaggagaatcacttgaacctggaaggtggaggttgcagtgagctgagatcatgccattgcactccagcctgggcaacagagtgagactctgtaaaaaacaaaaacaaaacaaaaacaaacaaaaaaaaacctttagtaatttcaattgctgcttttgttgttgttaacagctttattaagatataattcacaaaccataagactcactcattttaaatacacaatttgatggcttttagtatgttcaaagagttgtgaaaccatcgccacaattttagaacatttgcattattataaaaagaagccctatacctaatacctaacatgtcccaatccctccgtttctcccagccataaacttcctgtgtctatcgatttacctattctggacatttcatatcaatggaaccatataatacatagtctcttaggatgggcttctttcacttagcccagtgtcttcaaggttcacccatgttgtagcatgtatcaggacttattcctttttatggctgaataatatcctattgcatggtgtgataattaatactgtcaacttgattggattgaaggatgcaaagtattgatcctagatgtgtctgtgatggtgttgccaaaggagattaacatttgagtcagtgagctgggaaaggcagacccacccttaatctgagtgggcacaatctaatcagctgccagcatggctagaatataagcagggagaaaaatatgaaaggagggactgacctagcctcccagcctacatctttctcccatgctggatgcttcctgccctcgaacatcagactccaagttcttcagttttagagttttagaactcggactggctctttgctcatcagcctgcagatggcctattgtgggaccttgtgctcatgtgagttaatacttaataaattcccctttatatatatatataaattctgttcctctagagaaccctggctaatacatacggatgtagtacattttgcttaatcattgctattatttttggattaattgtgaattcgatgctaagttataaaaaaaagtgagacgtagtcccaactttcatccttgtggagctgctttggagcctacagggtatgttgacacacatgatttcatttgaacatgagcaatttcatttgcagctcaccatgatcctgggtgacagatgtcattttacactttagagatgagtccagacaacttaagagtcttatttagcaaaggttatatagccatatagttactggcaccgccagaactcaaactcaggccttctgaattgagtctgtgtttttcctggtacagtcaagctgcaggagcattaaccatgcagtggtgagtgtgtgaagattgacggtgttagcatacgtgttttacatctgggaggaagttgagagtagataaaagccatttaccattaccttcatttgctcccaacatgcaatcaccagagaatatgtagccagtagaagggggcctggggtctccaacctcaaagcaagaatgtcgcagtttctactggggatgacccactccttggggaagcaaatcaaccattcctttgttaaatgtttttggtagtgaaagaagctccatcttgggatgctaatcagccatactgacttctgattaacctgagttccaggaatgcctctaagatttctattttatcttttgtttcttgtataagagcatgtacttaaaataaatcttgcccttaagtcaaaacaactttgaccataaatcctgcccttaggaagattcacagtgccttcttgcctttccctggggggtggacttcaattgtcctacatgcccctcacctatggtatctaagccctgagtctgagggttagtagtactgtgatgcaccatctagtcttgcagttacctgagtcacagacatggcctctgtacataagtccctattaaatgtttctttctaagaaactggattagtcaatctctttctttggcctctcaacttcctcagactttgggataggtttgcatagacctgctcactgtggaacagtgttccgtcttcatatctccctggctaaacctctattcaaggttttacaactacgccattcctaagcagcaccattctgatcagagacacttttgccctgccctaattggggagaaatgagattcttgtcctgtatttacacccccacataagcccccaacacctttctgaaaatgtatacaatagcgtgcttaaatttccctgctccctgggctggaaagaaattacctaaaattctgaggactccattttttttttaccattttgcatttcccccaagcccaaatctaagtaatttgctaacaataaccattcatgcacccaagtgagtgcaaacgtatatatgacatctggaaactactttgggagagaaagaagaaaaaagggatttgcagttcatctgtgaacttgaattcaataaaatgagctaatacctccccctttatagcaggaggagatgatctccatccagactgtttcatccccaaaaaagctttggttgcaactcaagccgagctatgaccggggtgtagaaggctggcatttgtaacaatacattctaggtagctccacttctctcagaagctgtggtaaacccaaaacaagctcctgacaggtgcaggaaactcaatgggctgtggcaccttcggaatggctgaagaatgaaaagcagcactgacaaggatgccagggagcaggctgtggctaccgccttatgtctgctcaggatggggagatcatgtggctacatggcatcctgggccgaggacagcctatgaccatcgccacaggcctgcttgcccatagccgtcctgggccagcccagaccctccctggcagcaatcccctctgccactggcctggagaccctttagataggcaggctcagagtcctgtctgaggaggtgggaaagcgtgagcaaagccagtgatcaagtgctggctgctttgtgattctccttccatgaaaagagagatttttattgcattttgtgcgcatgtgcagagtggcttgctgtcttcccccagaattaaaagcgtcttttcttggttcagccttggggttgtttctggagaaccctagtagggttttgttgtcggttgaattgtgccctcgtgcccccaaatttcagatgttgaagtcctaagtcccagtacctaagaatgtgaccttccttggaaatagggttgttacgaatgtaactagttaagatgaggtcacaagggcgggccctaatccaatatgatccgtacccattatattaataaaaggggaaatttggatacgtatatgaacacagagagaataccctgtgaagatgaagacagatcagataatgcctctacactccaagaaacaccaaagattgccaggaaaccaccaaaagctagggaacagattcttcctgatataactgagaagaaaccagcccctgagatcttcttagacttcgaggctccagcgctgtgaagtgataccttctttttttttggaggtggagtttccctcttgttgcccaagctagagtgcaatgacacggtctctgctcactgcaacttccaccccctgggttcaagtgattcttctgcttcagcctcccgagtagctgggattacaggcatgcaccaccatacctagctaatttttggtatttttagtagagatggggtttcaccacattggtcaggctggtttcgaactcctgacctcaggtgatccacctgcctcagcctcccaaagtgctggaattacaggcctgaggcaccatgcgtggccaaggtgatacatttctgatgtttaggccactcggtttgtggcactttgttatggcagccctggcaagcaaatacaggctccatcccttggtgtaggaattacttgccatctttattctgtctttccctcatgtcacagagacaccctgcctccttcattgcggcctaatcacagcgagagagggtgctccctttgcttttgcaggaggttgtgcctcagtggattgtgtcatattaaacgcaactcttgaggcctctgcacagctaagattactgaaaagattttcttttaatgaattttctcagctgtgcatggtggctcatgtctataatcccagccctttgggaggccaaggtaggaaggggaagatcactttagtccagtagtttgataccagcctgggcaacatagtgagactctgtctctacaaaacataaaaaattagccaggcgtggtggtgccatgaatctttctaccaggagtttgcttctgctagatgaccacacaaatgtttggtttggctgcatacacgtgttgcttctgtaaactgctcttcatttaagcccaaaggccatgatgattatagctacaaatgggtcagcacaacttcattcaaagtccaatttgatgagcacactgaattctggccacatgtgctgtcttcaaggcttttaactcatggggcatgattatctacagcaagctgacagaactatggggcatatggctcctgggtcccaactatgggtactatcatggcaagagccaaatcagcactcactgtatgcccactcatttagttaacacacatctactgagccagtacttgagtcaggccctgtgggatgccctggagctgcagtgatgaataatgcacaatttctgtcttcaagcaattgagaaccagattaaagacattaaaaatccagcacaaagaatttcccaaactgtatttgagtaacacggatattccgagatattaaaaggcaattccaaggccaaggtgaaaggatcgcttgagcctggagttcaagaccagcctgggcaacacagcaagacccctatctctacaaaacatttaaaaattagctgggcatggtggcatgcacttgtagctactcgggaggctgaggtgggaggattgcttgaggctaggagttcaaggttgcagtgagctatgattgcaccactgcaccctggcccaggtaacagagcaagacctagccttcaaaataaataaataggggtgattccaagatggccgaataggaacagctccagtctgcagctcccagcgagattgacgcaaaagatgggtgatttctgcatttccaactgaggtacctggtccatctcattgggaccggttggatagtggttgcagcccatggagggggagctgaagcagggcagggtgtcgcctcacccaggaaacaccaggggtctagggatttccctttcctagccaagggaagccgtgacagactgtacctggagaaacagtacactcctgaccaaatactgcacttttcccacagtcttagcaactggcagaccaggagataccctcctgtgcctggctcggtgggtgccacgcccatggagccttgctcactgctagcacaacagtctgagattgacccgcaacactgcagcttgactggggaggggcgtctgccatcgctgggccttgagtagctcacagtgtaaacaaagaggccaggaagcacaaactgggcagagcccaccacagctcagcaaggcctactgcctctatgaattccacctctagggggagggcatagtagaacaaaaggcagcgaacagtttctgcagacttaaatgtccctgtctgacagctctgaagagagcagtggttctctcagcatggtgttcgagctccaagaatggacagactgcctcctcaagtgggtccctgacccctgtgtagcctgactgggaaacatctcccagtaggggccgacagacacctcaaacaggcaggtgccccctgggaagaagcttccagaggaaggatcaggcagcaatatttgctgttctgcagcctccgctggtgatacccaggcaaacagggtctggagtggacttccagcaaactccagcagacctgcagcttagggatctgactgtttgaaggaaaactaacaaacggaaaggaatagcatcaacatcaaagaaaaggacatccacaacaaaaccccatctgtaggttaccaatatcaaagaccaaaagtagataaaagcacaaagatggggagaaaccagagcagaaaagctgaaaattccaaaaaacagaacacctcttctcctccaaaggattgcagctcctcgccagcaagggaacaaaactagacagagaatgagtttgacgagttgacagaagtcagcttcagaaggtcggtaataacaaacttctccaagctaaaggagcatgttctaacccatcacaagaaagctaaaaaccttgaaaaaaggttagatgaatggctagctagaataaacagtgtagagaagaccgtaaatgacctgatgaagctgaaaaccatggcacgagaacttcgtgacgcatgcacaagtttcagtagccaatttgatcaagtggaagaaaggatctcagtgattgaatatcaaattagtgaaataaagtgagaagacaagattagagaaaaaagagtgaaaagcaatgaacaaaacctccaagaaatatgggaatatgtgaaaagaccaaatctgcatttgattggtgtaccaaaaagtgacggggagaatggaaccaagctggaaaacactctttgggatattatccaggagaacttccctaacctagcaaagcaggccaacattcaaattcaggaaataaagagaacaccacaaagatactccctgagaagagcaaccccaagacacataattgtcagattcactaaggttgaaatgaaggaaaaaaatgttaagggcacccagcaagaaaggtcgggttacccacaaagggaagcccatcagactaacagtgaatctctcggcagaaaccctgcaagccagaagagagtgggggccaatattcaacattcttaaagaaaagaattttcaacccagaatctcatatccagccaaactaagcttcataagtgaaggagaaataaaatcctttacagacaagcaaacgctgagagattttgtcaccaccaggcctgccttacaagaggctcctgaaggaagcactaaacacagaaaggaacaaccggtaccagccattggaaaaacatgccaaatggtaaagagcatcgacactatgaagaaactgcatcaattaacgggcaaaataaccagttaacatcataatgacaggatcaaattcaaacgtaacaatattaaccttaaatgtaaatgggctaaagccccaattaaaagacacagactggcaaattggataaagagtcaagacccatcggtgtgctgtattcaggagacccatctcatgtgcaaagatgcacataggctcaaaataaagggatggaggaagatctaccaagcaaatggaaagcaaaaaaagcaggggttgcaatcctagtctctgataaaacagactttaaaccaacaaacatcaaaagagacaaagaaggccactacataatggcaaagtgatcaattcaccaagaagagctaactatcctaaacatatatgcacccaacacaggagcacccagattcataaaccaagtccttagatacctacaaagagacttagactcccatacaataataataggagactttaacaccccactgtcaatattagacagatcaatgagacagaaggttaacaaggatatccaggaattgaactcagctctggaccaagtggacctaataaacatctacagaactctccaccccaaatcaacagaatatacattcttctcagtaccacatcgcacttattctaaaattgaccacataattgttagtaaaacactcctcagcaaatgtaaaagaacagaaatcacaacaaactgtctctcacaccacagggcaatcaaattagaactgaggattaataaactcactcaaaaccacacaactacatggaaacggaacaacctgctcctgcatgactactgcgtaaataacgaaatgaaggcaaaaataaagatgtcctttgaaaccaatgagaacaaagacacaacataccagaatctctgggacacatttaaagcagtgtgtagaggtaaatttatagcactaaatgcccacaagagaaagcaggaaatatctcaaatcaacaccctaacatcacaattaaaagaactagagaagcaagagcaaacaaagtcaaaagctagcagaaggcaagaaataactaagatcagagcagacctcaaggagatagagacccaacaaacccttccaaaaatcaatgaatccagcagctggttctttgaaaagatcaacaaaattgatagaccactagcaagactaataaagaagaaaagagagaagaatcaaatggatgcaataaaaacgataaaggggatatcaccacagaaatacaaactaccatcagagaatactataaacacctctatgcaaataaactagaacatctagaagaaatggataaattcctggacacatacaccctcccaagactaaaccaggaagaagttgaatctctgaatagacctcaatttctgaacaggttctgaaattgaggccataattaatagcttaccaaccaaaaacagtccaggaccagatggatacacagccgaattctaccagaggtacaaagaggagctgggaccattccttctgaaactatttcaatcaatagaaaaagagggaatcctcccgaactcatcttatgaggctagcgtcatcctgataccaaagactggtagagacaccacaaaataaagagaattttcagccaatatccatgaggaacatcgatgcagaaatcctcaataaaatactggcaaaccaaatccagcagcccatcaaaaagtttatccaccacaatcaagtcggcttcattcctgggatgcaagtctggttcaacatatgcaaatcaacgaacgtaatccatcacataaacagaaccaacgacgaaaaccacatgattatctcaatagatgcagaaaaggccttcgacaaaattcagcagcaattcgtgctaaaaactctcagtaaactaggtattgatggaatgtatctcaaaataataagagctatttatgacaaacccacagccaatatcatcctgaatgggcaaaaactggaagcattccctttgaaaactggcacaagacaaggatgccctctctcaccactattattcaacagagtgttggaagttctggccagggcaatcaggcagaagaaagaaataaagggtattcaattaggaaaaaaggaagtcaaattgtctctgtttgcagatgacattattgtatatttagaaaaccccaccatctcagcccaaaatctccttaagctgataagcaacttcagcaaagtctcaggatataaaatcaatgtgcaaaaatcacaagctttcctatacaccattaacagacaaaaagagagtcaaatcataagtgaactcccattcacaattgctacaaagagaataaaatacctgggaatccaacttacaagggatgtgaaggacctcttcaaggagaactacaaaccactgttcaacgaaataaaagaggacacaaacaaatggaagaacattccatgctcatgggtaggaagaatcaatatcatgaaaatggccatattgcccaaggtaatttatagattcaatgctatccccatcaagctaccacggactttcttcatagaattggaaaaaactactttaaagttcatatggaaccaaaaaagagcccacaatgccaagacaatcccaagccaaaagaacaaagctggaggcatcaggctacctgacttcaaactatactacaaggctacagtaaccaaaacagcatggtactggtaccaaaacagatatatacaccaatggaacagaacggaggcctcagaaataacaccacacatctacgaccgtctgatctttgacaaacctgacaaaaacaagcaatggggaaaggattccctatttaataaatggtgctgggaaagctggctcgccatatgtagaaagctgacactggatcccttccttacatcatatacaaaaatcaactcaagatggattaaagatttaaatgtaagacctaacaccacaaaaaccctagaagaaaacctaggcaataccattcaggacataggcatgggcaaagacttcatgactaaaacaccgaaagcaatggcaacaaaagccaaaatagacaaacaggatttaattaaaccaaagagcttctgcacagcaaaaaaactatcatcagagtgaacaggcaacctacagaatgggagaaaatctttgcaatctacctatctaacaaagggctagtatccagaatctacaaagaacttaaacaaatttacaagaaaaaaaaatcccatcaaaaagtggtcaaaggatacgaatagacgcttctcaaaagaagccatttatgcagccaacagacatatgaaaaaatgcttatcatcactggtcatcagagaaatgcaaatcaaaaccacaatgagataccatctcactccagttagaatagcaatcattaaaaagtcaggaaacaacagatgctggagaggatgcggagaaataggaacgcatttacactgttggtgagagtgtaaattagttcaaccattgtggaagacagtgtggcgattcctcaaggatctagaactagaaataccatttgaccccgccatcccattactgggtatatacccagaggattataaatcatgctactataaagacacatgcacacatatgtttattgtggcactattcacaatggcaaagacttggaaccaactcacatgtccatcaatgatagactggattaagaaaatgtggcatgtatacaccatggaatactatgcagccataaaaaaggatgagtccatatcctttgcagggacatggatgaagctggaagccatcattctcagcaaactatcacgaggacagaaaaccaaacaccacatgttctcactcataggtgggagttgaacaacgagaatacatggacacagggcagggaacatcacacaccagggcctgtcagggagtcaggggctaggggagggatagcattaggagaaacacctaatgtaaatgacaagttgatgggtgcaacaaaccaacatggcacatgtgtacctatgtaacaaacctgcacgctgtgcacatgtaccctagaacttaaagtataataaaaaataaacaaataaataaatggcaatccttgaaaagggggctccacagcaaactgcttgggaaatgctaatttttgtgacctttctcccccattccctttcctctctctgttataacacgaaagaatcctaaaagtaagacaataaaaataaaatgacaaaaaatatttatttggcttaacccatcatttctcaaaggtgtaagaccatgcaattctttttgtccaaaggatgcttattaacatcttacctaaaatatttactggaaatgttttaaaaacttaagtgcactcagcattgtgacaatcctgtaagacaggccaaaacaccataggaaaagtaaccagatggagaaaaatggcaattactggatcatacagggagaacaccgtggttgaaagaaatgggagtagttataacatgaaagaatcctaaaagtaagacaataaaaataaaatgacaaaaataatttatttggcataacccatcatttctcaaaggtgtaagaccatgcaattctttttgtccaaaagatgcttattaacatcttacctaaaatatttaccgaaaatgttttacaaacttaagtgcactcagcattgtgacaatcctgtaagacaggccaaaacaccacaggaaaagtaaccagatggagaaaaatggcaattactggatcatacagggaaaacaccctggttgaaagaaatgggagaaagtccaggcacggtggctcacacctataatcccaacactttgggaaaccaacatggaaggatcacttgaggtcaggagttcgagaccagcctggccaacatagtgaaaccctgtctctactaaaaattaaaaaatcagccgggtgtggtggtgcatgcctctagtcccagctacttgggaggctgaggcaggagaatcacttgaacccaggagttggaggttgcagtgagccaatatcactgcactctaccctgggcaacagagcaagactctgcctccaaaaaagaaagaaagaaagaaatcgagcaaatgtctcttaccaactcaattagaattggccagtaggtcattgaaaaagttaatcaaagcaaggaatcatgacaaattacacaagcaccttaaataatttacagtattttatcttaaaacatgtaactgttcattcctttaaacatctttttatgtatgtacactttgagtgtaggttgactgaccaaagttcttacacttactacacctgtgatgcatcctccatgatttccaatagaacaagatcaaaacaattgttacaaaataagttggctgcagcttcagtccacattcacaagtttccccatatatattttattcataggtatataattatatattaaataaaaatgtatataataaattaaataacctattaatttatctctgttagttaccctattgtgtccaactctctctcttacttttacaaagagaaagtaatcaagtaagtttcccttgaaatcaaaccctgatgtctcctcaaaggaagaactgctaagttttcaggtcaagtcgaatggaatgtacaatgagtcagggggctgagccctcattacagctaaatgatgtgtttcagctgatgacttcattgtattaagttttgccaaggcattcaacttaattttcttagaccaccaattatttctttgtcttttgcttttcacattcatatagtaataagtacaactggcacaaacaggtgtgggaacaagagcagcttttggccaagcatacaagtcaactactgggagcagaagcctgctgggatactagagagtggccataggctttcagtggaccctgatcataagtcagtttgtttgaaagaaaaaatggaaagcacaggctaaatcaagtttctgctctactgccatcggctgccctgggcagggagtgagatcttcaaagagcaatctgaagcaatatctgaaagttactaaagtaccttctagggagggtgggtctagctaacttaaacactcttgtttgaatgcaggaggaaaatttgaaggcaaaagataatttccccaacatcacagctgagagttgctattagccgtaacatccatctttccccaatgccatccaaataaatgtggtttgtttgttttagagacaaggtcttgctaagttgcccaggctggtctcaaactcctgggttcaaattatcctcccacttcagcctcccaaatatctgggattacaggcaagtgccactgcacctggcccaaatgaatgttgagtaaatattctgcaaacatcacttgaagggactgcagcccacttgattaggctgtctggaatgttcaaatatctggccttacttgagaaatttgtttttagcttgttaatatatacaatttagaacatatactatatacctgttttcatgcagactattttatatgtccacatgtcctcagttgtatgtatcacagagtttcacggtatatggcatgtttgactaaatgatggaagaggttcaagactagtcacctgcatgagttgattgcaaaggaacgtttggcctttggctaaataaggaggaagcattattgctgtaagtatcagggcaataatatggagaaatgacatggaaatagtatctgtcactccacccagcccagtggaatgaggctctgccagaaactgaaggatagttttcatataaatctgtcagataaggatgcttcaagagctaccagcagctctcctatgcagatatgcagagcacaatactcagcacccctgtaagcattaatgtaggcagtgcctggaactatagcagaacccatgaggccaagcaagaaatgagggaagctagtggaccagaggtccaattgtgatgctagcagtctgagatttatttgtgaaaatacatgcaacattcctgggcaggtgcaaatgggcatctttctaattgcagaggtcgtcaataaatagttggagcaaagacagaaaattctgagctatggccagtactgtgatttcgcctataccctcagattggtagggcacagtgaatcacaaaaaaacactattaatatattggtgcttgtaaatggcgtagcccctcccaggtttccctcttcgaggaagaatgtctcctgccacccgtagaggctctatggttaactaaagtcaatctagctcctcatcagcatcttaaagaggtgttcacaggaaatagcctaacccctaataccacagaaaagtttgctagtgcttccaaatgatctcaagaactagctcagaagccagtaaatgacaaaatctttccagatttagaaaaatttagccttttatttaaggtccaggagacaaaaggttgtgttcagaaatgtggctgcaaccaggagccaatggtcgatacagtttaggaccagggttgatagatccgaccctcaaggatgccatgtaccaaaaggcctggacctgatgatttaacattgacattggacagagtaatgttctgggagcagccagggcctgtgatgcctccaagaagctgctcttcaaaggggacctcccaaacatgcctgctaaagaccaacccagtgtaacctagtgatgtagtctggatgtttgttccctccaaatctcatgtttaaatgtgatccccagtgttggaggtggggcctggtgggaggtgtttgggtcttggggtggatccctcatgaatgggttggtgccctccccatggtcatgatttaatattcagtctatgagttttcacatgagagctggttgttaaaaagggtctggtacctcctctctcttgctccctctcccgctatgtgacacatctgcctctgtgtcaccctctgccatgaataaaagcttcctggctgggcacggtggctcacgcttgtaatcccagcactttgggaggccgagatgggtagatcacctgaggccaggagttcgagaccagcctggccaacatggtgaaaccccttctctattaaaaatacaaaaattagcggaggtgtagtggtgggagcttgtaatcccagctactctgaagactgaggcaggagaattgcttgaacccaggaggcagaggttgcagtgagccaagattgcgccactgcactccaacctgggcaacagagagagactccacctcaaaagcaaaaacaaaaaagcttcctgacacttcaccagaagctgagcaggtgtgggtgccatgtttgcccagcctgcagaaccatgaaccaaataaatctattttctttataaatttcccagtgtcacgtgttcctttatagcaatgcaaaacaagctaacacacctggtaaccctgtaagaataattgaattggtaattggcggatcaagtaaaatgtttccattattaggacatgtatctatttgtgccagactgttagtttctttaaatttctctgaacacaaaatctttagttctcaatctcagttacatctgaaaggtttcccaaatctcatttctctagaaagttcttcaaaccttccatttaaaaatagcagtcagaacatctagtaacttgaaagatggggagaatgctgttgttgctaagacattttttgaatgtcaaccatgtaatgtgtgactatgatcctggttcataggattacaacctaaattaacccaagttagtgtcctggcagatggccgttcctaaactgcctaaacttgtctctgtctctgttagattaagacaatcccatgatctttttgaagtactaacaaagacttacagcttcctgctctcctgtgctgccatgttgaagaagatgtagagccttttttattgctttctacaaattatgcaagtgagaaaaaaaaacaaataaaaacgaaaacactgaaaatcatccataaccttaaattaaccatacaacctttttagtcctgaaatagttgcttactgttaagtcaatagatgtaaacaagcaattcttgagaacctaaaatgtttctggcacttggctaggtgacataagatgtggaaaaggaataagaacgtcagtgtaggctctcagaagagttgattctcatgttaggaaatataataaaaacaagtacagccaaggattatgatgcagtggtgacccaccattggcaggatgaaaaaagaggagaagtactcttactcattcaacaaaaatgcattgagcacctactatgagttttctgctagtcatgtgaatcctgaccttaaggagataatagcagccagtcagaaaatcagaccaataaaatacacaaccagaagatgatatccaggttattgtgtggataaggtatagggagtacaggatggaagaaacagctaagttttctcgggcagccaagatgagatgttgcggaaagtgactcctgaaagaagggtggagcttgtagagagtgcttactgagcctgcaggacctgcctgactacatgccaagcactcttcatggattatcttatttaattctcacactagccctataaaataaggatttttatttttctccattttacagacagggagactgaaacaaagaagagttacggaacttctggatattacacaggcagggggtgagcctggagctctggcccaggcagcctgcctccagaggctgtgcttcccaccacccctccccgccaagccatatgtatacacatagccccaataccttggtattagccttctcccctgcctccttttataccacatctccccctcttcttcatctattgtagtgagaaaagcagatggacttggtgcattatccgtctttgctacaatgtaagaattcaagggtataaaccatagaccgttgtgttgagccctgaacttggatttttcagccaggttcgttcaggttatgggctgtccactgcccatcacaaatacaactgagacctcagattgaaaaagaatgaagttgcattcagtctctcttgttgcagtttctctctttacctgggatgaagatcattttcagaagcttccccatcctaacatgttagataaactgtctaagctactcagctgcttctcctccctcactcttaggatttgtctgtttctatctgtgcggtttggctctccctgttgtccttacccttttccttttgttctaagagcccagcactactctagcttctaggggttatcagcccacacccctccagctattccaggtcacacaacatctttcagtcccgaccaccaccaggcgacacattaacacctgcatttccaaagaactccaatagactttttatgacttttcacaaaattcttagtcccctgctttgttactagaacatgaaaattcttcctgaaatcaaacccaccttttgaggggcagtagaattttgctatgaggaagaaagcacacattcaacacagagaatgaaagttgggacaggatcacatgcccagagcatagcagacggcaagctctcaggatggtcagagtgggaagagctggatattagcttaaactatggaaaacttttcatgaagaggaaaaacctgagagaacttgaaaggtaagtaggaattaaggtgacgctaaaggaataagatatgaaataaacaggcatctgagtgcatttctctatgagcaatttaccaacctattattagaaaatgcttaaaagaggaatgtttcttctgtgttactgtacacctggatttcattcctgcatactcaaagctaaacctgcgcaacaaatcagctcttccttttgtaaaagaaataaaaccaaatttttatggttttatttattttacaaatgacaaaattattgtttgtaaaataattgttcctgggataagagatcagactattcaaatagagatataatttatggatttaaaattaaattcctttccaacattatctttagaatttgaatcaattagggaacataaacatgattgctattgggtgagactgcctctgaatacaaaaatatggtttgaaagctcagctcaggtttagaatcggtgagaaaaaaaaagggagaaaggaaaagtatggtgttgtcagcattcaaaggagaagtaatgtgcatctttagataaaagctttacaatggtgtgcataataatgatactgtttgttttaaatgtgatatatatatatagaaatgtgtacatagacatacaacaattacttatgaacaaatacactaaaagccagtaacaaagatcgcctctgcagaggggaacttagagctacaggaaagactctttttcattgtgtacttccttttctgattgaatttcccaccatgtagctcaattatcaattctaaaaaaaaaaatgtgtttaatgtaaaacattgtttcaaatttccaactcttaaatgtgagaatagatctctgaggtggaagaaagagatagaaaaagaagataggatgagaaggaagaaagaaaggacaaatcgtggaatagatgctctgctctgggcactaagagttgcagaaagagaataaacctttggtcacattgtccaagtgttagaaaaacatattccttgggccatttaagacaccacctgaaaagtagaatcaataattacagatgctttgtaaagatgagaaagactgtgggagatcaaagagaactaaacatgtaaggaactcaaagaactcaatagcaaaaaagcacataatctgattttaaaatgggcaaaagatgtgaatagacatttctcaaaagaagacaaacgcatggccaacaggtacatgaaaaaatgctcaacatcactaatcatccaagaaatgcaaatcaaaacccaatgagatattatctcaccccagttaaaatgtgttttatcgaaaagacagatgctggtgaggatgtggagaaaggggaaccctcgtacactgttggtgggaacataaattagtacaatcattgtggaggacactatgaagggtcctcaaaaaacaaaaaaaatagaatatcatatgatcccgcaatcccactactaggtaaatatccaaaagaacggaaatcagtatatccaataaatgtctgcactcccatgcttattgcagcattattcacaatagctaaaatacagactcaatctaagtgtccatcaacagatgaatggataaagaaaatgtggtacttacacactattcagccataaaaaaggatgagatcctgtcatttgcaacaatgtgggtggaactgcaggacattatgttaagtgaaatatcacaggcacagaaagacaagcaacccatgtttgcactcatatgtgggagctaaaaaattgatgttatggagatagagagtagactgatggtttccaaaggctcagaagagtagtggggaggtggagataaagaggtgttgtctaatgggcacaaaaatacagttagatagtaggaataagatctagtattcaggctggacacagtggctcacgcctgtaatttcagcactttgggaggccgcggcaggtggatcacctgaagtcaggagttcaagaccagcctggccaacatgctgaaaccacatctctactaaaagtacaaaaattagctggacgtggtagtgggcacttgtaatcccagttactcgggagactgaggcaggagaatcacttgaacccaagaggcagaggttgcagtgagctgagatcatgccattgcactccagcctgggtgacaggagcgaaaccctgtctcaaaaaaaaaagaaaaaaaaaagatctagtgttgatagcataataaagtgactatagttaacaataatttattgcataggttggtgcaaaagtaactgtggtttttgcaactttaaaaactgcaattacttctgcacccacctaatatattttgaagtaattcgaggagtggatttggaatgttcccaacaaaaagaaatgatacatgtttgaggtgatggatatcccaactaccctaatttgatcattacactttgtatgcttgtatcaaaacatcacatgtaccccataaatacgtatgactattatgtgtccataaaaaatgtttttaattcaaagagaaccacacaaacgtggagggaaggggctctgtgctggctacacacgggtcattgcagctggaagggactccagaggcaggaccatggattttaggaaaacatcagtaccatcatttgccttcatacaggtaaatttatatagtacctcaatacccattttctaggtaattttatggagtctacttgcctatcaaatttccctccaggtaatcatgaaactgacatgaaacagactagcagcatatacgcttcccctttaccagggcacatcatttaaaagtctgtgttactatacaagcacttcaaacattaacatgtctcaacccttaccaagaattctcaggcattgcatctctttttttgagacagggtctcactctgttgcccaggctggagtgcagtggtgcaatattggctcattgtagcctccacctcctggattcaagcaattctcccacttcagcctcccaagtagctgggactacaggtgcacaccaccatgaccagctaatttttgtatttttttagtcgagtcaaggtttcaccatgttggccaagctggtctcaaagtcctgacctcaagtgatccgcccgcctcggcctcccaaagtgctgggattacaggtgtaagggattacagggccacagcacctggcccgttccatctttaaatgcccattcccttcacacaaggccactgaggatggaatggcaattttcttctcttaattctcatcacatactgcctcctgcttcatgcgttcaattccccacctttccatttgcctggggctcaatcgaagttctccgatttttacttttctaacactgagtctatctttaagcagatgttttgttctgggaccagctctgtgaaaagcatttaggaaaacaaaaagtaatttacttgcatgaaagttaaacaagggtgtccaggctttcaaaagtctagcttaaacacaaaacaaaaacaaacaggaaaccctgaaataaacccaaaaaaccaaaacacacccatgttcacacacgagagtaccaatgttgccaaggacacagtttctctgttcacggtgggaaaacagcaattttgtcacagtagcttatttacaaaggacgttttcatacattagctttgaactggtcatggaaaaaattctttgacatagaataagtaactttcaggaaagtctcatggcttcatttattaaggggcctctaaccggacagggttatcctgttggatggtttcttttggtttatctcaggatgccaagtgctttctgtttttgcctgactagggcacatgattatgatgtgcacactaactcatcacagccgcagggacagatgctggttttgcttctagtcacttagtgttaagagataacgaggtaatagaattcatccggtgaggccaccaccctttttgtctctacccctgcgcacacctcatgccaatccacaccattccttcctgaaccatcagcagcagcaagcacaaagaaaccacaactcagaagatttttcaaaagtgccaaaagttggctagcagtcctatttgaacacagacgtggctattggacagcagttgtctagctcacccaatcttagatggatactttcctgtaacacaactaggtcaaacaatcttatcaccctgacagaacagttcctgtctttctctaatagaaatctctcctgcctttatctgagcccattccttcttgtgatatcttcctagaaattatatactactgaaaaaatagtaatcaaattacccttagcttctttcctcttggcaaatttacttcatatccatttttaaaatgaatctccccttcctaatcatgttgttattctttgttaatcctttccttttaagttgagttaatcaaaactgaacaaaatggccaggcacggtggctcacgcctgtaatcccagcactttgagaggccaaggcaggtggatcgcctgaggtcaggagtttgagaccagcctgaccaacatggtgaaaccccatcactactaaaaatacaaaaattagctgggcatggtggtggttacctgtgatcttggctactcaggagactgaggcaggagaattggttgaacccaggaggcagaggttgcagtgagccgagatcacgccactgtactctggcctgggcgacagagcaagactctgtctcaaaaaaaaaaaaaaaatgctctttatggatctcattaatgcaatgtatgaaagaagaactaatactttatacttagagctcatgtttcattttagtacatctcagaattatgctgatttttcacaacagcattcctagtagcatgtatttttttttatttatttgtattcaactatgcctcctatctcaaaggattattgacaagtttaatgggattttgtatgaaaagtgcttatcagaatgcccggcacatagagaacactccataaacggtgactatcatttttcattatttttgatactttggactagggagtcagtgaaatacgtggggaaagcgggtttgctcaagatgcattgtaggaaatatttaggtagtgaatagcaaaatatttgtgctccctgctttaagacaactcattataggaacactggaatttacagagctaaagtgtgcatttggcgtctgagatgaagagctgttcccttgctcagcctgtccagctttatttgcagggctgtctgtgggccctcgcctaagcagggactgcagactatcctccaagatgatccattagaaaaggaagttaaacaaagtaatccactgtgacactatatatgaaggatgattgtacaggaactgtatattcctggaatctgtagtaaatccacacagaagttttatttctggccaaggactcaacatcaaataaatctgagatatgacaaatagtataacaaaagtaaactataaaccaccatccatttaaaagaggagaattatgatccaagactaatgaaatgagcattaatatatgtacacattgatgacacaaaaggccttaatgaattactaaatactcatctggttttattatgtataacaattatagcagctcggtctcaaaaaaacaacaacaaaaaaatgtttaatgatgatggtgttctttcccactgaaagcattccttctctaaagtaagtggcgaccctattctcccacccttcacccttcatagcctcctaagttataaagtgtgatcatggcatcagtggggttcccaggagatacctggtgttcagtctttctcagccttcactcccgggaagtgacagtgtttgacatctattagagcacatcacgcttcagatgatgatgataaaaatgatcagattacatttttagatgttacctcttcaggtaaaatatatattataaaaccaaagatccaaatgggccatggtcagaccatatataaaaacagaactgtgaccataacctgcccaggaaaccagccccttatctacaataaacagtccagcaagcccgtctgctaaagccagacttgcaagaagtctgggaaataacaatctgagaagctaaacaataacttttataataattaattccaaatgaccaggaattgattaataactgacagctttcctagtttttgtcctcatttccaactttaggccaaccacaaaaggcgccttaaataatcacatggctgccggctcccagttagctaactccagcttcccagaccaacagcctccaatcagggcacacctgaagctgtcccttgtgtctgctgtaaagctctcccactcccctgcctgcctttgagtctctcccaaatgccagtgatggtggctgactccctcgctatagcaagctctgaataaacagcctttgctttctcacatggtggtcttccttcatttcatatatataagcggtgtgtgtatttttttaatgctgcccacctgcttcccgatcactcctccctgtcacaagacctgaaaagccttctcaaccaacaggtggaggcctggcctaactcttccccttcaccctcccctcctcacacttctaatgacacagattttctccttgaccaaatgctagccaggcctctctgagcccccttctagaccaggcctcaaccccctcagagtgcctgcttgagaaagcccaagactgacaaaagaattctatgcaccatctgatgaaaggcttctggcactttcttagagtacttactaaaaagggcttacaattgtgactccttcctctgtgcctttgagatggctgtgtatctcctacaaaggcaatcaaggacgtaaaaaaccattcctttacaatgtaatcatcaggaaggatagggccagtgtctcccagtctctggaaggacagaatccagactttgatcattgccagctagcagacacagctgcctaatcagcatttacatgcgtcaatcctttgtcagttttcaccttcctgactctgctgaagccccactggttcctctccgttaatccctcattgtcccttaaaatgcccagtcacctctgtacaaatcaaagttcagttcacgctggaccctcttccctattgcaatagtacattatgattaccatctgtccttaccacgttacctagtgtctggtttatctttggtactaaccaggtgtgcgcctccatccttcccccacccacaccaatagccagtagctggtcttcctgttacagtagggagctagtcaggcatgagcacagcaggagagcccccctccccaccaaggaatgtcaggagaccaacaggtggtgggcaagtggttgttacactgtttccctaaaacggtaattggtcgcagccagccctagggaaaggcaggctccaaacagaaaaaacctgaaactggtcatcatcagtttcctgataagatcttaggagttgggcgagtaagctgaagcatgcgcactaagaggcaaaatggcagcatttaactggtacatgaccttctaggaacattcagctggtaaaggaagaatgcctcaagtgagcatgggtacaacgccagtaaacacactgtgcatgcttccctcccaagcactagcaggccactgtgcatgcgacagcccaccccaagggaagaactagggaagaagggatgcaagaccccagaaatgccagtgtataaaaccctaagtcagaggtcaaacagggctcttgatctctcaatttgcccgcttagccctcttccaagtgtactttacttcctttcattcctgcttctaaactttttttttttaagagacagtctcactctgttgcccaggctggagcgcagtggcataatctcagctcactgcaacttccacctcccctgttcaacggattctcctgcctcagcctcccgagtagctgggattacaggcttgtaccaccacgcccagctcatttttgtatttttagtagagatggggtttcaccatgttggccaggctggtctcaaacttctgacctcaagtgatccgcccacctcggcctgccaaagtgctgggattacaggcatgagccaccgtgcctgaccctgctctaaactttttaaaaactttcactcccgctgtaaaacttgtgttcatctctcactctgccttatgcccttcagtcgaattctttcttctgaggaggcaagaattgaggttgctgcagacccgcatagattcaccatcactaacattaccttgggcagagtgctcagacctcaggttgtctgaaatgaaagtcactatcaccccagaacctgcatcctttccctactctttagaaatgtgatagctggtggcactcctgttaaatctttccatacctaagaaatcttggctgggcacactagctcatgcctgtaatcccagcactttgggaggccaaggcgggtggattacttgaggtcagaagttcaagaccagcctggccaacatagcaaaaacccatctctacaaaaaatgcagaaattagccgggcatggtggcgggtgcctgtaatcccagcaactcgagaggctgaggcaggacactcccttgaacctgggacaccactgcactccagcctgggcgtcagagtgaaactccgtctcaaaaaaaaaaaaaaaaaaaaaaatatatatatatatatatatcttctctgggtgaggacccactgctccatagagccttttctggtgagccagacaaaaacttttatttccctcatacaagtacctgtatgtttatgcacacctgtcttgactacacatctcaacagcttttcacttacagtaacatttaggaggtagcaatgttagctgtctaacagacatagcttatgcttaattcttgcaaccctggaaaggctgttatgtataaaatggggataataatatgtacttcataaggttgttatgaagagcaaataatgctggctcgtagtgggaggttaggaattaatgtccaattagagaatgaatgaataagagagaacacacagtagttcataaatatgagtttcccttccccctcaaaacagcagaaccagaaaacaagcaagacctaagcatacatctcacaatggtccttcatctgctgtccagcaacccgccacctcactaaactgactattctattttcctacgacacaaatagatagatatttcttatttttaaaatttagatctacatccctgcaacttctccccttgggtcctggctcagttcccaccagccatacaagataacatcaggtgcctgggcctccattttctttctaggacacccagtttggccttggggtgggctcccacaggtagctgggaagctgatgcccctgagtacccacgtccacccacacgtgaaaacaaaaaaaaatctcagaaagtaatttcgagcacgggtcaaagttctatttcacacttgcaggggcaagacagcaaaaggaaaaagctggttcacagcaactgtcttaggaaagcaaggcctcttttagaaacagaaaggaacgtctagacccgtggcttgtttaaacacccgctgctaggccccactgccagagctgcctatccagggccgagaatgtgcatttctaagtagttctcaggcggtgctgatgctgcggatctggggactgtactttgagaaccaccggtgcagaccctggccaacgttctttagtctgatgcgtcggggagctgtaaagctgccatccttcaccggtgggcaagtaacctggtggcgccaccccagggccagacccagggccggcctcggtgcgcctctagccagaaataaccagcactgggttccgctcaccggcaacgccaggtgggggccatctgaccactcaacagttttgctttttcttcaaattcggatacttagaaggaatgcgatgaaattgggatgaaggtgttttgctggccccgtggacagaccagacctcctcccatcggagcctcgggtctcacaccagccccccaggcggcgcgcggccccgtctcgccaccgcggcccgggtcgttcgcgtcttccggcgccgagggtgcctctgggtcccagcaccaggctccgtggcgcgcacgcgcggcagcttcttctagccccgccaggagacggcccagaagggctatgcggcgcggcctcgctcctgggggtggttaggaacgactgtttcatttcctccttcacccttcaaatctcagtttttgcttgggcttgaaggaatgggccagggtatcgtggacggagagtcttacaaaatttgagtttttgaggtcagaatttaaaagtagctgccgaaacccgggatcgaaccagggacctttagatcttcagtctaacgctctcccaactgagctatttcggcacgttctgggttgtctcctgagtaaactatcactgagcgctttgcgtccaactggcttgcttgtcttttcctggtgatcatgtacagcatttcttccttgtcctgttaaacggtgtcgtcggaattcttccacctccctccttctacgctgccactgggcgctgcacacgcgccttactttcttagattgctctcggcgcgcgcagcccgcacggtccaggagctgggtccaggcccccgatggcggctcctcgggatgctggttccgtcctcccagggccggtccccgcgagatccgaagcagcggggtcgcctcggggagctcctgcccaggcctggtagccccttcccttcgatctgcccctgcctgtgactatccacattcgtcaccttgctccccgaaaagttccaggccccaggtgaggagccgtgtaggcccaatacgattggatgaaggagtgtacggggcaggaatcgtcagactggcctctggagaggagtttgcagcctctccgtgctccgggcccgggaaatgtccaccttaatcatcacctctttgcatggagcctgactggcaaataaatgctgggtgagctcactaacgatgattattcagtcaatgctatttcccacacgagtcaacaaatgtttccgaagcacccactacgtgccaggctcattctttacttcccaaacgtcttactttttccattttttaatttttgtcgccaattaaattgtaatctgtcaaggcagggatcttacccggctctttagagctttgcatttaagtggaaacttcgcagccaatttggacggatggatggataggatggatggatggatggttggatggatggatggatggttggatggatggatggatggctgacttcaaatgcgaaagagaaaaaaatacaaaattagaaatttttgcaatctctattttctccgccaagcctcctcccttataagaaagagagtttctttctgggttcctttattgtgccaaatccaaaaaagagccgaggcgttgatggtatagtggttagcatagctgccttttaaatccaaagaaaccaaagagcttgagatttaacagaagtcagcagctaaggatgagagagagaccaaagagagcttggggctgggcagagttcagagaagggtttggggagcttggagtggaagagggagaaattttgggcagccaccctgtgaggatcgtacatctaaaaagagatggggaaagagacctttaacaggctttcatgtatgttatgaatgtagctacctttcccattctcctcaaaacactgcaggcaagacgaattattttcaacaactcttgggctgctggccggctgttccttactggattcaatcatgagatagctcagcttcttaaattttacaaaagttgtgtctttaggttaaaaatcaaatctgggaagtctcaaaatatatgttagagagtgatgggataacacatgtacgggctgggacatggtgttagtgtctctctttcttggtctcgtagtcacacctgcaaaccagctgcttcgtgcattgtcacctgggaaatgaaatcctaggtaactaggaaagtggcaggtaagttttgatgggatttaggctgggggtggggatgggtagcaaaggtccaagcaggatctaatggaaaatggaggaacaggataagagagagaggagaaggaagagtgcaaccaagaaacattgctttgtgatttaatgcgatgagaacccttggcaaattgtgagataatagacactacattgtcatagtgatcatttgtttagtaaaagttgattttagaaagtaagtgttgtgagagatgtcttggataagctgggtatccaggaaagtccttgtttatatatgttgtcccggaactctccatggtagtagcctcttcactgttaaacagttaaaagtaaggctggacgcggtggctcatgcctgtaatcccagcactttgggaggccaaggcaggtggatcacttgacgttaggagttcaagaccagcctggttaacatggtgaaattccatctctactaaaaatacaaaaattagccgggcatggtggcgtgcacctgtaatcccagctactcgggaggctgaggcaggagaatcaattgaacctgggaggcggaggttgcagtgagcggagattgtgccactgcactccagcctgggtgaccgagcgagactttctgtctcaaaacaaaacaacaacaacaaaaaacagttagaagtgttttggaatgactggaagataaataaacaatgtgatcacctactttattaactttgtgaaagcctcagcttgatgctctccgggtttctccctaggttttcctgttagtgaaaagatcttcaacatcaacccaatatttattgttgctgttttacaaaggagaccgaaagtttctgggacttagtgccacggtcccgaaactgcagccacctggggcactgaagaatatttcacatttttgagagaaacacagcgatgcttggcatctgtgggacgctatgcaaactacccagtagttcattgttttggcaagagattacatttctatcagtgatgtcatctctttcagcatgataaaaagtacccatgaatcaatggggaatatgaaattagggttgagatgtccaatctgtttccaagcttgagaaattgtacactgtccaggatacacacatcccaccagtaagttaactgtggtgagaatgaaattagggagtctctgagcctactctggcttgggaggctgcccttgaaaaaaaaaaaaagaatgaaataaaagtgtaacttttctttcaatttatatgtataatttttttcaagtggctacgaagttgttggacataaatccttattaagttatttggacctgagtacttaataaaaggaattgttcggcatttcttttggcctgggggcattggaaaaaattactgagacagtaagagctgcctgtgaacagagaaagcgaaaaacaattattatgagtttgggaaaaaccttgctttactcagcaagattgcagcgcaaagaagaactgtcagaacatccaaggagaccaagcgccacaggctaaataaagtgaagtgaaaatctgtgcacacacatcatagtaagaagagacaggtgataaagaagttggcattcaaaatgaggataaagatgttgaagaagactctgtgttggaaagaaactgtgtaagctgcagtcctgttttccaaatgagctcgcggattttggccaactccagtctaattacctatgattaaaaaaaccagctaattacgagaactaactagcagatctgagaataataaaactgaagagagtatgttgcatatagttataacagctaataaatttttgtgggtttttttgtttgttttgagatgggagtcttgctccatttattgcccaggctggtctcgaactcctgggctcaagggatcttcccaggtagctgggattacagacacacacaactgtgccccacttctgataaaaatttaaatggctgttaattaatctctccttcagtttgctccttgggattctgcagtgcacatgcatacacacacacacacatgcacacacacacacacatttttgggggcctctgattttaatcaatatttctttaaagtattttaaaaatgatgggggtatgtcaaaaggacctaggaaccagtttgaaggggctcctactggccaaaactgggacaatctgagcatcaaaataaataagaatattaatggattatttaccctttgaataaaataaaagtcctttagtacaataattgtgtggtggatgcaggggaggaattgaggattcttatagctgaatgaagtgtgcagactgacaaatttggaggtagtggtagcacgggatatcaccattttccaaacatcatagtaaagattgattcagtcaagaatcatcaatggatgttaagtctaaggggggacagttaaacgaggagcaggatcattgcatggcctcaaagtatttctccacagattgcttaaactgcacagtggagaaaacggacaatgccatgatccggtcatcaaaattagcatcaccaatgtaggacattcggtcatcacatgccttctattgtgatgccctgtaaaagacacaacacacacagtgctccaggcagggaagcagaacctaactttaatcatggagcagcattatacaaaccccaagtaaaggtcatcctagtaaataaatggcctgtattattcaaaactgttaaggtcacgaaagcaaagaaaagctgaggaactgttccatatgcaaggaggtgaaagaaacacaactcagtgcaatgtgtaatcccagactggttcctattctggaggagaaaatgctttaaagggtgctattgggacaactaatgaaattggaacatgagctgcagattagatgagtgtgttttatcagtgctaaatttcctgaagttggcaaccatagttaggtaagaaatatccttgtttcaggaagtacatactgaactattaagggatgagagacaatccactctcaaatagattctgaaaataaataatagtatgcatacatattattatatatgtaaacatatacacacatgcatgtgtatatatgaagataatattaaaaaatagaaacaaatattaaaatttggcgtatctgagtaaaaggtatatggaattcttctgtatcattttataacttttctaaaaatttgaaactcagaccaagcatggtgactcacacctataatcctaacattttgggaggccgagaccagaggatcgtttgagccaaggagtttgaggccagactgggcaacaatagggaaactctgtctctacaaaaaaaaaaaaaaacaaattaggccgggggaggtggctcaggcctgtaatcccagaactttgggagaccaaggcaggtgggtcacatgaggtcaggagttcaagaccaacctggccaacatggtgaaaccccatctctactaaaaatacaaaaattaggcaggtatggtggcgtggcacctgtaatctcagctactcatgaggctgaggcaaaagaatcgcttgaacccaggaggcagaggttgcagtgagctgagatcacgccactgcattccagcctggggaacagagactctgtcttaaaaaaaaaaattaaaaaattagacaggtgtggtggtacacacttgtggtcctagctacttgacttgaatggctaaggcaggagaatcgcttgagcctgggagggagaagctacagtgagctgtgatcatgccatgcactccagcctgtgtaacacagtgagaccctgtcaaaaaaaaaaaaaaataccctcagatttgtttttaaaataaaaaaaataaataaataatgtttggcggtcttcttgagccaagacaatttcagttagaatcatactatagctaagagctggaagagaatttagcatttatttcgcctgaccacaaattttacgctaatgctccggagacactaataagtaacttgcttgagattaccgtatcagtcttctcgggctgccataacaaaataccgtagactgggtgacttaaacaacagaaatttattttttcacattttggaagctgggaagtccaagatcaaggctttggaggattgggttcctggtgagggctctcttcctggcttgccgaggccaccctctctgtgtgcccacatgacctttcctccgtgtgtgtatgcgtgtggagagagaaggcttccacatctcacaaggccatcagtcctatcagattagaaacccacgcttacaacctctttagccttcattacctcccaaaaacgctacatccaaatacagtcacatcggggttagggtgtcaacatattaattttggggggacatattttttagtccacagcaattacacaaactgatacagcgctgactgctgacccatagagcatattccttaccttgcaccaaatactcttaatatttttcataaagactgtttcaatgaaaaattggcatgagaataaaaaacccaaacttgaatctagggctagggcccagttttctcctgcagatgcttttttatgggcatgtatatgctttttgaacgaagttgcttgatggatacaaagcgattcctccaaagttatatattaaagttgtaacttaggggagaagtatttaaaaaaattaatagcttgcaaagatcatcagtgtgctgaattgatccaaaagaagttaatttatttaaagccattaaaccacaagtccataaagaccttattgttttttgtttttgttgaatcacagacatcaatatcaagcctctgggtatacttaccaggccagaaacaattaagtaaattatactcagaaacaacctaccaagcttttcatatgttctaatccaatcctcccacatccatcaagcaaacgcctagctaatcatgtggactttgcacaataccctacaggccagaaaacttggattctagaacctgagtttcagaggcttggatgctttttaaatacttcttagcttaattgcttgtctctgccttttgatgaagtgggccagactcccaactgcatttctgtccccatctcctcatcttcccaccctacccttattcaaccatgaaggataaggcctgattattcacctagagaaatcaaatgaaataaatttaacacaacagtttcctaaatcccttaataattcaaaaaagaaatgtcagaaagcataaatcaaccagtctcttctgttaacccagtgaggtacacagctgatgtccaatgaccgggggctcagaaaaggaggccacgactcagagatgcctgtgcactttggtcctgttttcctttcagcctcccaggggcttcacattcttgacttttgtagggacttgcaactcgccaaaatggtataaagattaaactgaagacatttgagatacaacagatgaagcaagaagccttttctgagcttctcttatctgaggaaaggcacagccttccaagaaggaagctgccataggtcctctctgtctctgggggaatttccagcaaggaaggagactattagcactgggatatgaaactgcataaacaaacattatgacaaactgtcctaccttccgtttgtttccctaaagccatctgtctctcctaaaagctcatttatttcccacagaagtcctctctctccctctttccccctcttaagcaggtatataaacccttatccctagctgttcagccagcctcttcatttgaatgttcccacatgcgtgtgagttaaaatttttctcccattaatctgtctgtttttagttaattcacagcccctcccgccacccactgaaccctaaaggcaaaggggaaatctttccaacactttccattgctttcatccatttctctagtcctgtttatttatttatttgtatcccttaactccatctcctcccactggcctactcctcacacccctcactttttttttttttttttttgagatggagtttctctcttgtggtccaggctggagtgcaatggcgcgatttcagctcactgcaacctccacctcctgggttcaagcgattctcctgcctcagcctcccgaatagctgggattatagaaagccaccaccacgcccagctaatttttgtattttgagtagagatggggtttcaccatgttggccaggctggtctcgaactcctgacctcaggtgatccactcgcctcggcttcccaaagtgctcagattacaggcgtgagccactgtgcccgacccacacccctcacttttactcagaaatgtagtgtgtttagtataaaagtcttggagacaaggcagctcttctccaccctttctgcctatcttcattgcacacacaggccagggtttttctagaggactttagcgtatgggcaggagagggtgacaggaggggatagtggagttttgctgctctctgtggtcagggctcaggcaggactctaagggaagcctcactgaacccactgtcctcagtccttctgtggttggaatggtcagggcacatgtccacgactcttccaattagtgggatagaaagcagggccctagccccagattctaccactcagctccctagcctattctcctcatttgcaattggaaaagttgactccgattttcccaaccacaaaagtttacatacaattcagaagggaataaaactgcaacccaaccctctcattcgacatgtctttcccattgatgcctgattctttcccgacaggcaggaaggaatctatcaaaccacaggccaaagatccctattcagacagcacattttaccctcatgacaataattacctaaatagttggataaggagaaatgcttcaatttggcaatgactgatgcttcccccacaaaaaatgcaagaaataaaatccaagtgctgttctttgtcctaataagaaatatacaaggatattcaatcatattggtgcttgtgtaatatttacaaaatgtaagggacaatgcctctaccccatgtatgaatcaatgaaagaccagagaggttaatgactgctagcgtgacccagttatctggtgacagaggtaggactagaacttaggtctcagatcccaggtcagagttgttatacttgtttatgtttgtttgtccctgtataagaccaaccttatcagaatagaagtttgcttaaatttatgataacatacactttgcggatattaagtttcgtggcaaatgatcttcctggctttactcagtgttgaatcttgctgcttacactaaactggcgcattccctgagcccatgaagaatttctatgccaaccttgtgaggtaggagaataggctctgaaggcagggaacataggccattcacactgacttcttagaaataaatcaaaaggaaaaccccaatcttccacttccaagtaacaaaaggaacagaggctacttcctttgcaacccccacttttctgcgtggcagatgaaaaactgaaagtacttttgattcgtcctctcccgcaaccaatcaggctggtcgcaggccaagtcttcatttgcataggaatataacgttgtaacttcactttagcctctgataggtcactttccacaaccagtcagaagtttgcatagggtgtaactttgtaactttgcctcatcctctgattggtcccttcttgcaaccaatcagactgatcacagaccactactttatttacatagggcgtacacaaagtaaccaatgggaaacctctagagggtatttaaatcccaaaaaattctgtcatcgcgggctcccaccctgtggagtgaacttttgttttcaataaatctctacatttgtttcttcctttcttactttgtgcgttttgtccaattctttgttcaagacgtcaagaacctggacaccctccactgttaacacttgttttgagaatcttgaggcctgattactttcaattaaaaatctggggcccagaaaaggacatgctaggaatcatttatacttcagtgtaaacagaggtcttcccacccatctttgggtgggtcttttgatacactatacagtaatacgcatagcattacctatgaaggtttcttgctaaaaatgtttgatctgaaactacttaagcctccaggtagacctaacttccagtttatacgaaactgagaaaatggagaaacgagttagatgacaccatgaagaaataaccaggtacatctagaatatgaggcattctctaagacatctagcctgcggctgttttcaaaaatgtcagtgccatgaagacaaaaaaaacccacatcaaaaagagagacagctgcatgtttaacagactgaaaatacattaccaaaagtaatatgtgaacctttactgaatcctgctatggaaaaaaaaaagctgtaaataagataattttggggggacatggagaaattagaatacgtatattagatattagggaataaaatatatgactccattctcttaagtataaaaataatatggtcattaggtaggagtatactattggtttcagaatatttgtgctaaagtatttagaagtgaagtgtcatgacatcaacttattttcaaacacacaaatttccacatacatacacacacaaaaatcaatatggcaaatgttaacaattgttaaattcaggtagagaaatacatctttcaatttttctgtatgttttaaatttttcataaaaattttaaaaaattagtcttgtcttacacatcctagaaatttttggatttcaatcctattttccattaaagactgaacaactttccttcttatcaataggattttaggcatggaaaggtgattaaagatacattttgtgaaaatgaacagacccttccccaagaccacaaacggcctaagtagcctctttatctctttattgctaaggcttgtcttgtacataccaagatcatacttttaattctcaagtcaggatatgtggtctggcaaaagattttttttcttgcttctgcttttactcatatgaaagccttacaaaagcatacaaatcaaaacatttgtagatataatttttatttgtttaacaatgaatcatctttatttaaaaatcacataaatgaaattacactgtttcaaggatttcaaatatacagtttccatgtcttgtagtcaactccgatgtgatttacagcaaaatctttaactttacaaggtcagcttaataatctaccataatgtatgtgaggataaaaatgtcttccttgtcttttatttttaacttttaatttcctttttgaatcaggctttgagttttgaccttcacaattactaaggaaagtcagattgcagtaattagaatactatagtaacatcatctaaaactatggtttgattagtccattaacttaagcaaccacaatttcaactcctgagaaatttaagccgatttaatttgagctatgtggtacactattccctttttatgattgctgaaatatctgcagaataagtcagaggtagcatacttatttagaatattacaagagcgaaagaaaatcccgcagagcagcaaatcaatttaagagaaatgtgcattttctaaatgttaacacatggagctttcatttgacatctactatccaaatagctaaaatgaccactttcctttagaaatttttcttctgggcagagaaatattgctttatattttcccttaagtttattcaattaaaaaatgtgaagggcagagctccagagccattacatttttaaaattttctggaaatataaatttttttttcaagagcttatttggcttagtttaggtacgatttctcatctctgtaatttccattcagccttataacctaaaaacatgctttccctcctctcctacgcctacagttaattctcacaacaatcttcattaagagagcaatgttttcattccaagtcaatagatgaggtactaggcaaagtatagagctgttactagacatgcaactggagagctttccagaacaggcgtaccttggagatattgtgggttcagttccagaccactgcaataaggtgaatattgcaataaagggagtcacagaaatattttagtttcccagtacatttaagttatgtttacatgatactgtagtctattaagtgtgcaatagcattatgtctaaaaactcaatgtacatatcttaattaaaatattttattgctaaaaaatgctagcaatcatctgagcctttagtaagtcatagtggaaggtctggccttgatgctgatggctgctgatttatcagtggttgctgaagactgaggtggctgtggtaatgtcttaaaataagacaacaatgaagtttgctgcattgactctcttttgtgaaaaatttctccatggcaggccgtgctgtttgattgcatttacccacagtagaacttctttcaaaattagagtcaatactctcaaaccctgctgctattttatcaagtaagttcatgtaatattctaaatcctttgtcatttcagcaacgctcacagcattttcaccaggagtaggttccatctcaagaaactactttttttttttttttttttgctcatccataaaaagcaactactcatccattgaagtttgatcatgagattgcagcaattcagtcacatcctcaggctccacttctaaatctagttctcttgctatttccaccacatctgcagttacttacttcctccactgaagtcctgaacccctcaaagtcatccatgagggttggaatccacttctttcaaactcctgttaatatattttgaccttctcccacgaatcatgaatgttcttaatgacatttagaatggtgaactcttttcagaaggttttcaactcactttgcccagatccttcagaggaatcgctatctatggcagctattccttacgaaatttacttcttaaataataaggcttgaatgtcaaaattactccttgacccacgaggtacagaatggaagttgtgttgccaggcatgaaaacattaatatccttgtacatctatatcagacttcttgggtaactaggtgccttgtcaatgagcaacaatattttgaaagaaatctttcagtcatctaggctttgttgtataatttctagagcacaggccgagtagatttagcataattcttaagggccttaggattttcagaatggtcaatgagtgttggcttcaacttacagtcaccagctgcattagaccccattaagagagtcctctgaaactctgaagtcagacattgacttctcttctcttaactatgaaagtcctagatgacatcttcctcttttttttttttttttttctttgagatggagtttcgctcttattgccgaggctggagtgcaatggcgtgatctcggctcactgcaacctctgcctcttgggtttaggcgattctcctgcctcagcctcccgagtagctgggattacaggtgcccgccaccacgcccagctaattttttgtatttttagtagaggcagggtttcactatgatggccaggctggtctcaaactcctgacagctgaaccacccaccttagcctcccaaagtgctggtattacaggcgcgagccactgcacccaacctagatggcatcttctaacagaaggctgtatggtctacattgaaaatcttttgtttagtgtagctactctcatcagtgaccttagctagatcttctggataatgtgccacaacttctccaccagcccttgctgctcaccatgcacttacgttatagaaacagtttctttccttgagtctcatgaaccaatctctgctagcttccaacttttcttctgcagcttcctcacctctctcagctttcacaggattgaagagttggacctggctctggatcaggctttgacttaaagaaatgttgtggggcaggcgcggtggctcacgcctgtaattccagcactttgggaggctgaggcagatggatcacttgaggtcagtggttagagaccagcctaactcctggtctctcctggtgaaaccccatctttaccaaaaatacaaaaattagctgggcgtggtggcagatgcctgtaatcccagctactggggaggctgaggcaggagaattgcttgaatctgggaggcgatcatgccactgcactccagcctgggtgacagaacgaaactccatctacaaaagaaaaaaaaagaaatatggatggtttgatcttctatccagaaaattcaaattttcttcacattagcaatagggctgtttcactttcctatcattcatgtattcactagagcatctctgttaatttccttcaagaacttttcctttgcatttacaacttggctaacaggtacaagaggcttagcttttggtctttctcaacttttaaaatgacttccacactaagctcaatcatttctagcttttgatttaaagtgagagatgtgtaactctttatttgaacacttagaggccattgtagagtttttgtttgtttgtttttcagagaaagagtcttgctctgtcgcccaggctgaagtgtagtggcgccatctcggctcattgcaacctctgcctcttgggttcaagcaactcttgtgcctcagcctcccaagtagctggaattacaggcgcgccatcactcctggctaattttttttttttcttgagatggagtttttgctcttgtcacccaggctggagggcagtgacatgatctcggctcactgcaacctccgtctcccgggtacaagcgattctcctgcctcagcctcccaagtagctaggattacaggcacctgccaccatgcccagctaatttttgtattttgagtagagatggggtttcaccatgttggccaggctggtctcgaactcctgacctcaggtgatccatctgccttggcctcccaaagtgctgggattacaggtgtgagccaccgtgcccagctcattgtacggttattaactggactaatttcaatattgtctcaggggatacaaaggccccgaaagagggagagagatgggagaaaggcctagcagtggagcagacataacatacaacatttatcaattaagttggccatcttacatgggcatgatatgcggtgcccccaaacaattatactagtaacatcaaaggtcactgatcacagaccaccataacagatataataatgaaaaagtttgaaatgttataagaattgccaaaatgtaacagagataagaagtaagcacatgcagttggaaaaatgccaccgatagacttgctcgactcagagttgccacaaatcttgaatttatacaaaatataattatctgcgaagcacaataacgtgaagcacaataaaatgagatatgcctgtcgtttggagccaagagaaaaagatgaagacctagaattgcttcttttgctcttcaaaatcgacttaagtagagaaaacacaagggggcttcgacttcctaaatttgggatagaatggttacattggtaaaatataacattttccatcacccggtaacactatttttaagagtatgccaattaaaacatagtgggtttagctataaaacacaacagtattaaaaatactattaaagctaaggacggatcctagaaaaatcattcaaggttagaagtttctataaagaagcaccaaagtgagaattaaagatcagtctttctaaacaacaacaaaatataagtgaaatcagatataagacttgcaaaactggttcacctctttcttaaagtgtgagatttgagcaagaaagtgagctttatgtagtcaaatggtgtttgactacaaatcgtaaaaatgcaagagattctgcctggggtgaggagggagggggaaatgtgtgtgtgaggaggaagggggagagagagggagagagaaattgagagacagacagacagtggcaaagactctgctctttaaaaaacctgcaaatgaatagagatgctgagtgtccagggaggtgattacacccccaggagctccgtgtttagtggaacacacacacctataaacaaattgtatgagtacagtgtgatggtaatatagatggcagaacttcaacatctgcaggtgaggtcaaagagaggctcaagctagctaaagattctagaagtgcaataaaacaatttttgcatctttcgtactggcaaaaattaaaggtctattaatacccatggcttgctagagtgcaggaatttcatctctatctttcaaattttaagtgcatgtgcttttggacccagatataccaaatctaggcattaatccttcagaaatacacgctcctgtgtacacgcaggtgtatattgagatggtcaatgcagcattttttcaatagttgtaacagtataaattcatggccttcaaacatggctgcaccttcactgggcggtggtagagctgctgctctcattttcctctgagacactacaaaactcacttctctcctgttgccttcccgactttcaggaagaaaattgaggccacagtgaattccctctcgtccctccccaaaagtcactgtatccaatctcatctcagctcctgtcattactaatccagaaagatgagatcaaccctatcccaaagtgagtctttccctagggagcccatctccatggacactgtactccattcattatgcactcctgaatatcatttatctttcttcatttattgctcatctcttcagcttataattatacagaagtcctttctgtgctaaaaacaaaacaaagcagcttctgaagacctttccttaagcctgtgccttccttagggctggccctatcttgactcttctcagctcattgaaaggctaaattccatttttccatcccttgattcctaattactactcaatcttcataatccagaggttctctccctctccccacactagaaaatttgcctgcacattgccaaaaaccagtggacacttcttagtctttgccttactgaacttcagctggccatctgctggttattgaatgtctctcccttttgctttggtggcgttatttcttcctttcttccactcctctgactattcctttttttttttttttttttgaggcagagtctcaccttgttgcccaggctggagtgcaatggcgcaatcttggctcactgcaacctctgcctcccgggttcacacaattctcctgcctcagcctcctgagtagctgggattacaggtgcccaacactacacccagctattttttttgtatttttagcagagacagggtttcaccatgttggccaggctggtctcaaactgctgacctcatgatccacccgccttggcctcccaaagtgctgggattacaggcgtgagccatcgctccccgcccattccttcttttttatttcaaaattgattgattgatggattgatttttaaggctagtcaagtgaagcagtgggagtaatttttttttttttttgagtcagagtttcgctcttgttgctcaggctggagtccaatggcacgatctcggctcactgcaacctcccgctcctgggttcaagcaattctcctgcctcagcctcccaagtagctgggattacaggcatgtgccaccacgcccagctaatttttgtattttttttagtagagacagggtctctctatgttggtcaggccggtctcaaacccctgacctcaggtgatctgcccacctcagccttccaaagtgctgggattacaggcatgagccaccgcacctggcccataattttgttttttaaccattccttcctaatttccttgggctgcttgcctgcaacttacatattagtgtttctcatggcttgtctgtaaatcattccacccaccatcaacactgtcattttgtatactttccttggggggggggggatttaatctactttcagatgttaacagtcatttaactcccaaatatgtatgtctagatcttgagccctgaccaccaatctgagcttcagattcacatacttgcctgttcaccaggtatctccacttaacatgttccacagacccttaaagctcaacatctctccaagctcaacatctcctaattgtaatccaccattctccactctttccaattcaacactgaaaaccttaaaataccactcatgtcaaaaaacagctcctccaatgtatcatcaatcagtaagtttttaaatctaaaacgttctcatgtctgtcccagactttcccttccctgtttgcggtgctgtgctttaggccttatcatcgccagcctgatttactgcaacagcttcataacttcaatccctgcaggaactcattcttgtcttccttaaattcgtcttccatgctattgccagaaaaagctatcaaaaacataattctgcagtcaataaaaatggcaaaagatctcataatatgcaaaaacattcatgatatactgctgcatgaaaaaaaccaggctccacaacagtatgtccattatgatcctctacttggtttttaaaatgtatgtatatatgcacaaaaaattaaattacatacatcaaaatattaacaggaattatcttccagtgttagattatgggtgattttcttttattgattagttttccaagttttctataataagcatattatttttgaaactaggaaaaagataaatcctgtaaatctaaccatgtcaatttcttccttaaaatccagaattagctcttggctggtaggataaagtccaagcatcttaccatggcagacaaggccctccatgacctggctaccacattcctctccagcctcacctccccatctcacattatggaacagtggctttcaaacattagggggcttctgaattactgggccccactctcagggcttctgattctgtaagtctgggaatttgtatttctaacaaggtcccaggtgatgtgaatgctgtctgtccagggccacatttaaaaaaatcattattatggcaaaatatacataatgtaaaagccatgttcaaccatttttaagcgtacaattcaggggcattaggtagactcaatgttgtacagccatcaccattatctggtttcaggacttttttcatcatctaaacagaaactctgtacacattaaacaatacctcctccctccctcctccctcaagccactggtaaacctctgatactgtgtcaatttgcctactccaggaacctcatttgagtggaaccataccacttttgtccttttgtgtcttcaagggttatccatgttgcagcatgtgtcagaattccactcctttttcaggctgaataatattccactgcataagccattttgttttatccatttatctgttgatggacatttgtgttgtttccaccttctggctattgcgaatactactgccatgagcattggtgtgcaggtatattagcctctgccttcaattcttttggatatacccctagaagtggaattgctggatcatattataactctatgtttaactttctgaggaaccaccatattgttttccagaggctgcgtcatttcacattcccggcagcaatgcaccacggtcccaatttctctacatcctcattgacagggtgttgttttaaaaaataatagccatcctgatgagtgtcaggtgatatctcattatagttttgatttccttaatgaaatggagacacgttttgagaatgactatgctagagtaaaactgatggcgtattgtttcctgaacacacagcactatttaaaacttggtgctttcactctgatgatccctctgcctggaatcatcctgtttcctcactaactcccattcattaagtcacagctcaaatgtcatctccaatgagccttctaggaacctccagattgggtaagctgacctcacagaacctggaagcaactggggcagtggaaggcggaggtaagggaggtaggcgagggtaaggcattggataaaaagcaagtggcgcagctgggcgcgatggctcacgcctgtaatcccagcactttgggaggtgggcggatcacgaggtcaagagatcgcgagcatcctggctaacacagcgaaacccccatctctactaaaaatacaaaacattagctgggcgtggtggtacgtgcctgtagtcccagctacttgggaggctgaggttgcagtgagccaagattgcaccacggcactccagcctgggtgatggagtgagactctatctaacaaacaaacaaaaccaagtggtttggttgaaagtctgtatagagagcaattaaactccaagaccccctcctcccctacaaatggcaattatcaaggtctaccatttggatttccctttaagaaaaagcttgccattcagctggcaagagtgcagttagccagcagcttccacttgcaatgccttcgggatccacctggtcgtttctaagtagcccctggccaatggctgagcacaatagggaacccagccatttctgcccaggtggggcttttttttcaggagattttgctctgcagatccctgttgagctggatgagattctgaagcccactctgccaaccctcttcctcaccccttccttttcacagatgtctgatctacgctgcagcctgaagatttcttctgcccaattatgcatcctcccttttgtatctttcacaagcattaactccctatcctattaataaactgctagcacctctaatttggcctcagccactacttcccagaggacccaaatgacacagtcacttctaagagtggtctaacaaaacagttgataagatgggtttagactggatcactttctgcctgtctggtcataagaataccatcctgggtgaggcagggggcatacacagtccctagcataaggtagtgatgcagttgctaaaactttcatgttggtgacttggggggaatgttctttggaaggggaccaccctgccctgcttactgcaataattcaggcacttgaaaagctcaggagaacacgtcttacaagggcagtggaattgttggtctttaataagttgtactgatgtcctccagaagggtaatgaaaagctaagaacaagaaataagtgacaactaagtgtgagggccttatcatgaggtaggagaatagaagaagcccaagaccaaactcagtatttaatagtttaaaagctgcagacatctttaaaggaatccactcagacagtctcatctttgtgtcagggtcctagattttcccaaccagcaccctaaccttggctgaagcaaacttaacaaacctacctcagctgggcctctggcctggctgagatagtaaatcaaaaacaaaatcacagctgggagcagtgatcgcatgagaacttactatcgcgaagacagtgtcaagaagccaagagggattcgccgccatgacccaatactttagaaccaaggcaggaggatcacttgggtgcaggagttcgagaccagcctgggcaacatagtgagaccctcgtctcaatttaaaacacaaaatcacaccttggaggaggtgaagatgatgccacccttgaggatctcaaggttacagagaggcccccaccaaagctccgtttaattcaccagtctggccactgctagaactgggtagatcctggtgaaatgactgcagtcaaggccagctcaattaaggagcagctctgctgtaaagaaatacctgcgactgggtaatttataagaaaagaggtttaattggctcacggttctgcaggctgtacaatcatggcgctgacatcccttggcttctggggaggcctcagggagcttttacccatgccggaaggcaaattgggagcaggcacattacacagtgaaagcaggagcaagagagagaggcagtagcggggatggagggtaggtgtctcacacttttaaacaaccagatctcacaaggacttactatcttgaagacaatgtcaagcatgagggattctcctccatgacccaaacaccccccaccaggccctacctgcagcactagggattacaatgcaacatgagatttgcacggggacaaatatccaaacttatataccaggttctgatggcagctgctgtgcttatgtggcatcttctttgctgaagtggattagaaggaccctggaacatagtatccagccactgatttgctgtatgtgttcttttccatctcaaccatgatgatcagaaaccaggagcatttgcagtttcaccttagggctatgtaagttctgctctcctaagagacttgggtgtcctgaacatcctgtagaatgtcacagtgatctatcacattgatggtgtcatgctgatcaggcagaattagcaaaggtggctagcaccctgatggctttggtaattcacattcaccccagaaggtgggagataaaatctgatgaagattcaaggacttgtgatttcagtaaagtttttaggagtcaaacaatcaaggtgtgccaggacatgccctccaagtaaaagtcaaactgctttatcttatatccccttcctcagagaaggaaacacagagtgtggctttgggttctggagggaacacattccacacttagggatactgctccagcttatatactgagcgacagaaaaggctgccagctttgaggggtctggggcgggaaagaggtctgcagcaggtccaagctggggtgtaagcattcctgccacttgggctatatgatgtggtaaaccctatggtgttggtggtgtcagtggtagagacagatgtagtgtgggttttatggtgagccccagtggagaataactatgcaggtcccatggttacacctgggaaagaccatttcaggctcagtggagaatcatgcctttggaaaataaattactgtgccatggtagacccagaatacttgacgacaagacaccaaatgaccatgcatctagaactgcccatatgtactaagttcacttggacccactgttaagggctgaaatgtgtctcccccaaattcttatgttgaagtactaacccctggtacctcagaaagtgactatacttagaaacaaagtttttaaagaggtatattaaaatgagatctttaaaatacactctaatccagtatgactggtgtctttataagaagagaaaatttagacacagagtaaagatcacataaggacagatgatggccacctgcaagccaagagaggcctcggaagaaaccatccctgccaacaccttgatcctgaccttggacttctagcttccagatctgtgagaaaattaatttatgttgtagaagctacccagtctctgatattctgttatggcagttctagcagagtaatgtgcccacccactcagagtcaggtggagccagcagcagtccactggaagatggaaatggcacatctgggatcgagcatgagcagaatgggagagcacaggtaagttgtaagagcaggtaggccagactcccatgtcaccaccttagttctttatacctgtggccatatagagggtcccatacaaccaactgaaaggagaaaaaaagttgatcttagtttatagatggattggcctgttctgtgggtgcaagccaaaaatggagggtggttgcctgaaaaccatgcaggggtggccttaaaaagaatgtggaaagagaaaacctttccaagaaaaaagcttcgagtagtatccctgctcatgcactatgtatagtagtgacctgtggtgagaatatacatttagtcatgaccagtagcctggctagctactttggggcttagaaggaaaaagtctagaggagcaggaaacaaggaagtaaaggttggagaagcgtggataggcctatctatgggagagggtggggagtgtgaagatctgtgtattccatgttaacactcactagaaagcaaccaccatagcaagaggcactgaaccacccagtagataaaatgacttggtcagttaactttagccagctttcatcatcagccaccccagaactaccatgatgggcacctgaatggaataggcctcactgtacagatggtccctactcttgggacccacagcatgaattctcacttaccacagccaatgtagctattgtcacctgtgaatatccaacctgctggcaatagagacaaatactgagcccccaatatggcactattcttcaaggaaacccaccagctacctggtgggacatgaactccattgggccctttccactgtgaaagggctagtagctgattctcacaatagacattttctccacatgggttgggtttgcctttctgcccgcacagcctgcccaattttgcttcctccttcttttatcgttatagtcattactttctctctgcatctgcttcctgtaagactcaactgacacacctgtcttccctctctttctctccagaaaggggaaattggagaaattgaatagaagaggtatggactcagggatccctaagcacagtgggaggctggtatttaagggtatttttaaagtataagactttctaatgaggaattatgatgcctccataccaaaatctgcattcttaatagagggccacccagtttcttttccctttctcaacccaatagccaatcagttactttttcaagtcttcttaaagtctttagggcaaagaaggattaaaaatatataatcaaatttttttttatttttctacagcaaaataaaaacattattttaaaaagcaatattctacattaaatacattaagatattgacaattttataaatacaatcattttaaacagtaaacatgataaatttctgatacaaggttttacatacgttaattgtgaaaatataaaaactttacacacttctcttaaaaagcattcaacgtaatcaattttacaaaattatcaatttaaaaagtgttagatatgcttctattttgttccattattaaggcaatgatagcatatcagatcttaaaaaagaaatggtgaattagggcctaagacatcctatattgcctaaaaacgaacatttcagagactttcttaggcactgagttcaaaaccagtgaaggttgccttctccctagcaccactacccctcatggttgtccgaatcaggagacttcttcctggctacccttagggagagtcttctacacctattatttcctagtttctaggagaaagggtttcagaaagaattttgacatttaaattctatgccagtactgaaactctcccaaagattgaggcattctgcatttgaattttatacagaaagtcatgaatctaattccaaaagaaaagagtgcacttcatttggtcacttaatttcataccacttggcgaggtaggataactttcttctttgacaactgtctcgactatataaatggtgattataccggaaagggttctaatgccttttccacattcttccagttgtgaaaattctctctgtaccattcaactaataggaaaaaacaaaagacaaaaaaaaaaaagaaaagaaagaaaaactaaacatcagttaaccaacctttactgagttcctgctagctaagtcttgcccatcagctaagcagcagacaagggctgactaatgatgtaaacaatttgattttgaacttaacaatgaagtcaatcagaagacatttaaatcacctaaaaaatttatgattaaaaatcaactatttttttcttcttaacttctaaagtcattcaatactgaacttggtataaatatttaagattctgattttaaggaatttggggtgtgggaaataagtcatctgccctggttttaaggttattttatataaaaaagtataatacagtgtttagtcgtataaatatggtaacactgcatgagaggcacaatgagttgatgtgaacttccttgctttttttttttttttttttttaaagagatggggtctcgctgtcacccagactagagtgtagtggtgcaatcgtagttcactataggcccaaactcctgggctcaagagatcctcctacctcaccctcctaaatagctaggactacaggcatgtgccaccatgccccgctgatttttttactttttgtagagacagggtctcgctatatttcccaggctggtcctgaactcctgacctcaagtgatcctcccactttggtctccaaagtgctgggattacagatgtgagccactatgcccagcaccttccttctattaatatgtgaaattattttatattgctatactatcagtaaaagcttttttagtttaaagaaatctgatagttttaaattattttttgtttcttaatatttgacttaagtatttgtatttcaagctctgaatcaaaacttttttttctacatctgggtagagcttttctcatgaatacatttctaaatacagctttaacatgtatacacagactttatatgcacttattttaatagatttttctgcacatactaaatttatttcctctgttggtttcaatataaaaagcctcaagacacaaaaaagactgcatctatatttcaccaactctaagatgccactgatggatcattattttacatacatgtaaaaaagaaaaaagctacaataataattataagacaccagtgattataaaaatacataccttttaggagtgtgaagaaagtgaaaaaatatgtacctcagaataaataatacaggtatttgattaatgctaacaagatatgggaagattgatcagaggttggtttataaaattcaagatgcttaggaaacacaggactgctactagaaatatatgaaatgtggcaatttgaaaagtacgaatgattcaacacaatattccactggtttgtataatgttctggaaataagttatttttcctttaaatttttctgacttgcccccaaaatgattaattcaaaacatacttgttttctttattccttctttccaaggcactttaggtctccatcctaagccatgtattttttctgacttcattgggtatctcatgtcattggtgggtcttggaaaacaaaacagatttaaaataatattgtagatatatatttacaaatttagatattaggagatatgtgtttatgcatttttaccacaacccaacttttctctttacaaaaattcccaataggttttctgcagaaagtctgtaaaatcaagtatatatttaaaaaaaaaaagtcacccataatgccaggtgcctaaccctctctgtgtcttgtcttcttgtttcagccacgatctagatataagtgaagtacctgacacatccaaaaaactcaacaaatgttcaatgactaaataaacaaatacacaaaaacttattagaactcatatgccaggctgtgggtcaggtatttcatacacattataaataagtgttagaatacttttataagaaagatgttattattggccaggcaaggtggctcatgcctgtaatcccagcactttcagaggccaaggagggcggatcacgaggttaagagatcgagacaatcctggccaacatggtgcaaacccgtctctactaaaaatacgaaaattagctgggtgtagtggcgtgtgcctgtagtcccagctactcgggaggctgaggcaggagaactgcttgaacctgggaaggcagagattgcagtgagccgagattgcgccactgcactccagcctggcaacagagcgagattctgtctccaaaaaaaaaaaaaaagatgttattatccctatttcacactggaggtttgaaacttcagacttagaaagggtcaatagttttttaagtcacatagctagtaagtaataatgctatacttaatttgtatggtacttacgattatgaaaaaaatgttttaccagaaaattcaaaacagataaactagttattggtcaagtccacatattttataattttataagtacctaagatttcacaacctttccccaaggttttaacttgttactcacctatcattaacataatcaacccaattttccatttcagactctgaattggtctctttgatctgtcaaaatggaaaaagcttttgagtcaaattataaaatgagatcagagaataacaatagtatttaatggctgattaaaaagaaaacaactgcctcatagcagggaagacagctaaaatgaacatcattttagtaacactttctatactttataacctaaattccatctgaagctcagatatacacattggattttggttattattcagttcctctttctattaaactaagatttaaaattgatgtcccctaatatacatggacattcataactactaatgtaattattttatatatcactgttacttgttttaagacaattttatatttctgcaaatgacttatgcagaaatataattagggaatgcacatttagtgaattattttttcctgaaaagctgttactaaataggtgatccaacttaatttaagacacatatggtacacaaaatcattaatttcattttctacttgcttacttttaaattaagtaagctgtatgcttctgattttgactaatggtcactgccactaacaattttgaaaataccaaccttttaaaacagatacataccagttgtattagttctttggcaagctggacaactgacatttcaaaattggttccgatgttataaatttcacctggtttcccttttttgaggacagtgagaaatgcttctacaacatcagtagcataaaggaagtttcttgtttgaagccctgacccatgaatgcaactaaagagattaaacgaagtgaaatcataaagtgtaaaaaggtaaactctcctaaagcattgactgggtactacaactccagagaagctaattcccatggggatcccagaatctttactgaaaatacaaattctcgtagcttttctaaattttgttcatatttcttaatctccaaaccttctgaggggactcagtaggaaagtgacccctgtgaaatgtgtattcaattttatgtcataagttcattttaaagaaatatctacagttctatgaattaaataagtcctttgagaaagtaaaattatataaaaatagatttcaaattttaatgctataattcaaagttctatgataggtcattaagatctgaaattatctcaacaattataaaaataagatacagattattttaaaaactattacactggagaaatgattcttaaatttagtggggcattcaattctatggcctttaagactttatgatatttaagaaagtgtcaccaaatactctaacataccagaaaagcatatgggtaaaaaggtaataataacataccatttcctgttgtgctgtagcaaagatataaattttggaataacctaaaagaatatttaaatatcatttcagactggatatttactcattagtatgaatctgaactcataccaaaattaaaagattattaagaaatatgcatatggattgcttctaattatttttatcagtttattaaaaaacctactatagtatttgatatgtaaaagaactcctagtttgctatttcataaagacaggttacttgaagataaaatgatctaaataggggaaaaatgcagaaaaagtcttcatcagacagttggtctcatcataaagctcacctgtgtgctgacttcataagggcagatatttgtatcttacttattgctttacatatagcacctatgcattaagtgcttcaggaatttatagaaagtaaattccagtgctcttggattcaaagaaaacttaaattaagcaaagtaaatattaatacctgcaggtcatgacatggccctttcctttgggcaaacagatcaatgcaaccagctgggaagcaagaaaacccagtctccaaatttaggcagagtagccaaagttatataaaatcaggcttgatgatatagagccaattgcacaggcattttcagcctctaaactacattttttattcattacttgtagtactttctggaagatattcgtgcctacacaataaagatgagttgaggcacagttagccagctgacactaagacagttaatgtatacaagcttcttgcatcactatctagctagcttttgactttctgtatacgctgacatactggtctgactgcaaacagggagtcaactgcagcgtgacagtagaggtagaagtattctatagtgctttagagtctttagaagtacaaggtattttcacatatatcattctcattggatctttcaaaatccctgctaagtggtgaagccagctggtgagtgtcagccagcttgagacttaaaactcaagttttcaaactctaagtctgaaggaatctgcaagtggtgttatacagcatataaaattatgtataatttacaacatattattttagacaaataactgaaaagaggttatttcaaacaatgagaagttacaatcactgaaaaacaccatgaattaagaagtaaaatttaccttttctggatattgatgtggtccataaacattactgcttcttgtgatgacaactggaaacttaaaagaatatccaacattaaggcttttaaaaaggtctaataataatgattattttaaagataagcagaatttcaaaatatgggcacctttgcctaaataattccacacaccttaaggtcaaagggaagagatttttttctaacgtaaggtttctaaaaaggagagaataggattcagataaaggcagaggttccaaaagaaagaagaggaatattcttttattagtacaagaagataaacacagatggcacaggtttataagtctgactgatagcaaaacacggaagaactttccagcggattattttaaagaccacctcaaggactcttaagttggctctcttcattgtaccaatccctacaaataaaaagagctactatgaaagtgaaaaggactgatgccaccagaactcaaatggtgagggaatctttaggaattccaaggcttgcctctctgacccagtccctaaaaactcacaaagagcagtgggaagccaaatgtaggagattcaaggtgaggattcatatggggtaaggctcccatactgacactgtcagagccaccaggggcaagtctacttcccactcatgaggagccacaaaagccaaatcatgcagacagaagcacatggcagaaaggggatctgtcttccctctgtcttcctccactcataggactccaacctcactctgactatagctgtaacactctacctactactgaaatagaaaaaaaaatgtatattcaagattcaagttattcctttaatgatgaactgaatacgaagaggtcggccctaatttgtccacacaatagaggaaattagtttttaaaattccataatatgtaaattttctcaatctatgccttctactctaagcatgctgctaaaagctgacttgggctgggcgtggctcacgcctgtaatcctagcactctgggaggccgaggtgggcagatcacttgaggtcaggagttcgagaccagcctgagtgtcagattgcgactgtctccgaacaataaatagaaaacttaaaaatattttgaaaaaaagaaaaaaaaaagctgacttggagttttaacacttaagtccaaaggaaaatgtttcaagagtttctgcaatcagttcttaccttatattgttcccagtaagactgtacaaaacattcagcagctgctttagatgatgcataaggatttgtaggttgtttgggtgaagattcatcaaattcctatttttaaaaatatatatttaaaaaagtgttatgcatattttaagtatagaaatcagagcatatgttaacacttcaaatgtcaatcaccaaattttaaaagccacttcttaaatcctatgtgcctggtgttttcccaaggacatgtggtaacttctttaacgtgcacaacaatcctatatagcagagagagagaacagcaagtgtaagggccctgagacagaagcatgtccaaaggaattgcaggaaggctgatgtgaggcgagagacagtgggagaggaggtcagaaagctagaggaaggccatacccttgaaggccaccgtaaaacaatgactgattttgagcagagtaatgccaggtctgacttacattttaaaaatcactctggctactgtgttggatctgatgtagggtggcagggtgcatgaagaaagaagtttacctgataaaaattgcagagaattgaaaaatggttacttcttggaagcagaattgaaaattgagaagtggtcaaggtttactttttctcactgtaagtcttttcagactatttgattttcactatgtatgtgtcttggtaaaataagtaaattcataaataataaaataaacagaatgagatcactgcagacaccaattataaaaattatagattagacaatggagtcttctttgcctaaaaagtgtaatatttatgcatgatttattttaaaaaatagattctaaggctggacacagtggctcatacctataatcccagcactttgggaggccgaggcaggcggatcacctgaggtcaggagttcgagaccagcctgaccaacatggagaaaccccatctctactaaactacaaaattagctgggcatggtggtgcatgcctgcaatcccagctactcgggaggctgaggcaggagaattgcttgaacctgggaggcggaggttgtggctagtcaagattgaaccattgcactccaggctgggcaataagagcgaaactcccatctcaaaaaaaaaaaaaatagattttggtttttacaagaattttacactgtctccttgaaattccaatatgttttcctgactgaaagggaaagatgaacaggtagtatgctgcagcctaacttatgctttggtccatggaatgacattcaccatatttgtaagagtgggacaaaaaggtgagatttgcaattctcttgcaaaattacaaataaatctgtacctaaagagaattctggggcatgaaaaaataaatgaataagtctctaccaagactaggctgttgttccccatttggggaggtatcacttgatctgaacagaggagacaatagaataatattctatgacggttaacactaagtgtcaacttgacgggattgaaggatacaaagtattgatcctaggtgtgtctgtgagggtgttgtcaagggagattaacatttgagttagtgggctgggaaaggcagagccaccctcaatctgagtatgcaccatctaatcagctgccagagtggctagaatataaagcaggcagaaaaacatgaatagactagactggcctagcctcccagcctacatctttctcccatgctggatgcttcctgccctcgaacatctgactccaaattcttcaattctgggactcagactggctctccttgctcctcagctggcagatggcctattgtgagaccttgtgatcgtgtgagttaatacttaataaattcccctttatatatctattctattagttgtgtccctctagagaaccctaatacactctgaagagtgccacaagtgtatataatttgaggatgaaaaaagcccagtgtaggtttaataaaactgtatcatggtacatggttaagtaggtaaaatatacattttctaagctcaccttatcaagactgccaccatatacttcatctgtgctgacataaataaacttctccactctggcttcatgagcagcacttaccaaaacgtgagtgccataaacattaacataggtaaactcaaaggcacgtacgaatgaaagatctaaaagaaaagagtgaaaagctaaaacaagtctacccaacggataaaacaaatgccaaatgatggactcaggtttaaggagagtactagtcactgttcttcatttaccacagctgcaagagttataataataacatacacaggcagtcatatttatgatttctttaaacctaaattacatagtacatgtaaattctcagaacccagaaaactaatgttaaatttgcaggaaagttttttattctataaggaagaaaatttaaaaataatacatgaaaatttaaaatgtttttaaattaaaaaaaattatgaattacagggataggctttttaagatcaatctgttactgctgaaagcaataaatgctgaatgagttatttaaacataaattcaccttacaagaattgaacctctataaccaggaaacggaaggaacttccttaatgatgaatcacaatccagaagcaataatggaagaggatgataaatttgaccatataaaaattttgcatggttaaaaaactaaaaacaaattaaaaagacaaaaatgacaaactgggaaaaaccatgtgaaattacagagataaagggttagtatcgtcaatttataaagaactttaaataaattaagaacaatcctatagtaaaacaggtaggagacataaacagtttagatgaagaaatataaatgggtccttaagattacgatgatcaatgtcacttacagtaagaaaaacccaaattaaaaactcagagataccacttcttacttaccagactggcaaaaattcaaaaagttgacaaatcacttagttgttgaggctgttaggcaaaagacactttgtacactgacaatgatgatgtaaaatgtttacaattccctaaggaaggaaacttggaaatatctagtcaaattacataggcatttccctctaacccagagttatgggctaaactgtgttctccccataattcatcttaaggcctaaccccttcccccagaacctcagaatgtgactatatttggagatagggctcttaaggaggtgattaagtgaaaatcaggtctttaggatgggtcctaatccgatctacctggtgtccttaaaagaagaaatgtggactcactgtgtgttttggaataaagtaaatgagtaattaggatggtgctgttgagaaccaaggtgttcagggtatggaaaagatgatataaatgaaagactgaagaacttaaacaaaaaatctcaatgcggattggacatttcagtataaacccatgtcatatttaatcttaagtaaataggcaaataatattccctagttttgttaactgaaaaagccttgacacaatgtccaatcagttaataagcactcccagtgcccagactgtggcctctaaacaccatttcccaccaaaaggaacaatggctcctgacagaaagggctgattccagatctagggggaaaaacattgaagataaaactgaaacatcctatcaaaccagaaagttagatggttgtcaaagactgctaaggtcatgtcaaaaaggactcaggaagcaactagaagagcctctcaatggctaatggtgagtcattttgaacataaataagaaaaataactgcaaatgattaaaacaaacaaaatcaaatgtgttaaaatctacaaattcatagcaatattaagaaaaaagaaaaatgaggatgcttggaaaccaactcattatagtaaaatctactaaataaataaaaataatcaggcacttaacctggcttttccataacaattaaatctcaaggtaaccaaataatgtataaggaaaactttttttttttctctctctctctgttgcccaggctggagtgtagtggcgcaatctcagttcactgccacctctgcctcccagattcaagccattcttgtgtctcagcctcccgagtagctggggttacaggtgcccactaccacgcccagctaacttttttgtattttagagatggggtttcaccatgttggcgaggctggtcttgaacgcctgacctcaggtgatccacctacctcagcctcccaaagtgttgggattacaggcgtgagccactgcgcctggctggaaaacttctttttatgtagatattccaggtataaatgaagaatgacataattaggatatcattttgtaaacccctaatataatgactactgactatataaaatagtaataatgtcatctagtggaaataaaaaaacaaaataaaataagatcaatttaaaattccaggcaggacatggtggctaatgcccgtaatcccagcactttgggaggcccaggtgggtggatcacctgaggtcaggagtttgagactagtatggccaacatggcaaaaccccgtctctactcaaaatacaaaaaaataaaccgggcgtggtggcacacgcctgtaatcccagctacttggtaggctgaagcacgagaactgcttgaacctgggaggcagaggttgcagtaagccgagatcacaacactgcactctggcctaggtgacagaacaagactctgtctcaaaaaaaaaaaaaaaaaaatccagataaaaactgagttaaaaatagctaaaaatggagttggaaattaaataggaagagggcaaaggttttgatgaactttacactttgataagctaattacacatctgtaatttgtagagtaaccactccaagagtacaaacagaacatataatttccaaactagtagagggagaaaaagagaataagaaaaattcctcagtcaaatccttaaaaaaagcaagcaagcagttttttaaaataaacaattttttacaaaggaataattcttttttttaaaaaaagtaagcagcaaccaaggaaacagaacaggtgggaaaagaaagcgtacagtaagatggtagaaataaatccaaatacagcaacaaactaaacactgagggcaaatgccgaggagggtcagaatgggtttaaaaaaatcaaaatccaaatacatgttgtttacaagacatgcagctaacccataaaactagagaaagtttggaaataaaaagatggaaaaagtatcatgaaaatactaaccaaaaaggaagtaacacagctatattaatgtcaaacaaaatagattttaaagcagtacacatcaccggggaaaaaagatcacttcataagtataaaaggttcaattcaccagaaatatacaagagatttaaagaacatcattaaccaacttaacctaatggatgtgtaaagaacaatggacccaatgtttgcaagttaacattcttttcaatacacacacgatttacggaaagtgaccatatactgaaccaaaaagcaagtcgtagcataaaggactacaatcatagagtacgttatctaatcacatacaattaagctagaattc

SEQ ID NO: 242 - DNA, 837 bp, Homo sapiens
gctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcaaccctgcccactcaggcttcatcctgcacaataaactccggaagcaagtcagtaaaaaaaaaaaaaaaaaaaaaaaaaa

SEQ ID NO: 243 - DNA, 1552 bp, Homo sapiens
ttcactagcaacctcaaacagacaccatggtgcacctgactcctgaggagaagtctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcagggtgagtctatgggacccttgatgttttctttccccttcttttctatggttaagttcatgtcataggaaggggagaagtaacagggtacagtttagaatgggaaacagacgaatgattgcatcagtgtggaagtctcaggatcgttttagtttcttttatttgctgttcataacaattgttttcttttgtttaattcttgctttctttttttttcttctccgcaatttttactattatacttaatgccttaacattgtgtataacaaaaggaaatatctctgagatacattaagtaacttaaaaaaaaactttacacagtctgcctagtacattactatttggaatatatgtgtgcttatttgcatattcataatctccctactttattttcttttatttttaattgatacataatcattatacatatttatgggttaaagtgtaatgttttaatatgtgtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctg

SEQ ID NO: 244 - DNA, 581 bp, Homo sapiens
acaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgccggcccatcactttggcaaagaattcacccaaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattc

SEQ ID NO: 245 - DNA, 491 bp, Homo sapiens
cccacagactcagagagaacccaccatggtgctgtctcctgacgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgcccctttgg

SEQ ID NO: 246 - DNA, 576 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggc

SEQ ID NO: 247 - DNA, 488 bp, Homo sapiens
cagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggc

SEQ ID NO: 248 - DNA, 633 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggcaaaaaaaaaaaaaaaaaaaaaaaaaacaaaaaaaaaaaaaaaaaaaaaaaaaaaaaa

SEQ ID NO: 249 - DNA, 833 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggtgaggctccctcccctgctccgacccgggctcctcgcccgcccggacccacaggccaccctcaaccgtcctggccccggacccaaaccccacccctcactctgcttctccccgcaggatgttcctgtccttccccaccaccaagacctacttcccgcacttcgacctgagccacggctctgcccaagttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaaggtgagcggcgggccgggagcgatctgggtcgaggggcgagatggcgccttcctctcagggcagaggatcacgcgggttgcgggaggtgtagcgcaggcggcggcgcggcttgggcctcactgaccctcttctctgcacagctcctaagccactgcctgctggtgaccctggccgcccacctccccgccgagttcacccctgcggtgcacgcttccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcggca

SEQ ID NO: 250 - DNA, 393 bp, Homo sapiens
  misc_feature (75)..(75): n is a, c, g, or t
  misc_feature (81)..(81): n is a, c, g, or t
  misc_feature (89)..(90): n is a, c, g, or t
  misc_feature (95)..(95): n is a, c, g, or t
  misc_feature (167)..(167): n is a, c, g, or t
  misc_feature (179)..(179): n is a, c, g, or t
  misc_feature (194)..(194): n is a, c, g, or t
  misc_feature (237)..(237): n is a, c, g, or t
  misc_feature (249)..(249): n is a, c, g, or t
  misc_feature (276)..(276): n is a, c, g, or t
  misc_feature (285)..(285): n is a, c, g, or t
  misc_feature (295)..(295): n is a, c, g, or t
  misc_feature (312)..(312): n is a, c, g, or t
  misc_feature (358)..(358): n is a, c, g, or t
  misc_feature (370)..(370): n is a, c, g, or t
  misc_feature (377)..(377): n is a, c, g, or t
tttttttttttgccgcccactcagactttattcaaagaccaggaagggccggtgcaaggaggggaggagggcccnttgganggccagcnnggaanggaacggctaccgaggctccagcttaacggtatttggaggtcagcacggtgctcacagaagccaggaacttntccagggaggcntgcaccgcaggggtngaactcggcggggaggtgggcggccagggtcaccagcaggcantggcttaggagnttgaagttgaccgggtccacccgaagnttttgcgcntgcaggtcgntcagggcggacagcgcntttgggcatttcgtccacgttgcgccacggcttttgggtcagcgcntcggccaccttntttgccntggccctttaacctgg

SEQ ID NO: 251 - DNA, 468 bp, Homo sapiens
  misc_feature (6)..(6): n is a, c, g, or t
  misc_feature (12)..(12): n is a, c, g, or t
  misc_feature (15)..(15): n is a, c, g, or t
  misc_feature (18)..(18): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (57)..(57): n is a, c, g, or t
  misc_feature (93)..(93): n is a, c, g, or t
  misc_feature (99)..(99): n is a, c, g, or t
  misc_feature (129)..(129): n is a, c, g, or t
  misc_feature (132)..(132): n is a, c, g, or t
  misc_feature (135)..(135): n is a, c, g, or t
  misc_feature (148)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (291)..(291): n is a, c, g, or t
  misc_feature (318)..(318): n is a, c, g, or t
  misc_feature (321)..(321): n is a, c, g, or t
  misc_feature (333)..(333): n is a, c, g, or t
  misc_feature (384)..(384): n is a, c, g, or t
  misc_feature (387)..(387): n is a, c, g, or t
  misc_feature (405)..(405): n is a, c, g, or t
  misc_feature (414)..(414): n is a, c, g, or t
  misc_feature (448)..(448): n is a, c, g, or t
atggtncayytnacnccngtggagaagtcygcygtnacngcnctntggggyaaggtnaaygtggatgaagyyggyggygaggccctgggcagnctgctngtggtctacccttggacccagaggttcttngantcnttyggggatctgnnnacnccngangcagttatgggcaaccctaaggtgaaggctcatggcaagaaagtgctcggtgcctttagtgatggcctggctcacctggacaacctcaagggcacctttgccacactgagtgagctgcactgtgacaagctncaygtggatcctgagaacttcaggctnctnggcaacgtgytngtctgygtgctggcccatcactttggcaaagaattcaccccaccagtgcangcngcctatcagaaagtggtngctggtgtngctaatgccctggcccacaagtatcactaagctngcyttyttgytgtccaattt

SEQ ID NO: 252 - protein, 190 aa, Homo sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 253 - protein, 207 aa, Homo sapiens
MYSAPSACTCLCLHFLLLCFQVQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 254 - protein, 345 aa, Homo sapiens
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRARDSDGAEEDVALTSYGTPIQPQTVDPTQECFIPQAKLSPQQDAGGV

SEQ ID NO: 255 - protein, 1030 aa, Homo sapiens; identical to SEQ ID NO: 22

SEQ ID NO: 256 - protein, 581 aa, Homo sapiens
MPLKHYLLLLVGCQAWGAGLAYHGCPSECTCSRASQVECTGARIVAVPTPLPWNAMSLQILNTHITELNESPFLNISALIALRIEKNELSRITPGAFRNLGSLRYLSLANNKLQVLPIGLFQGLDSLESLLLSSNQLLQIQPAHFSQCSNLKELQLHGNHLEYIPDGAFDHLVGLTKLNLGKNSLTHISPRVFQHLGNLQVLRLYENRLTDIPMGTFDGLVNLQELALQQNQIGLLSPGLFHNNHNLQRLYLSNNHISQLPPSIFMQLPQLNRLTLFGNSLKELSLGIFGPMPNLRELWLYDNHISSLPDNVFSNLRQLQVLILSRNQISFISPGAFNGLTELRELSLHTNALQDLDGNVFRMLANLQNISLQNNRLRQLPGNIFANVNGLMAIQLQNNQLENLPLGIFDHLGKLCELRLYDNPWRCDSDILPLRNWLLLNQPRLGTDTVPVCFSPANVRGQSLIIINVNVAVPSVHVPEVPSYPETPWYPDTPSYPDTTSVSSTTELTSPVEDYTDLTTIQVTDDRSVWGMTQAQSGLAIAAIVIGIVALACSLAACVGCCCCKKRSQAVLMQMKAPNEC

SEQ ID NO: 257 - protein, 346 aa, Homo sapiens
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQRRKSGLVSFYRDWKQYKQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 258 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQATTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 259 - protein, 89 aa, Homo sapiens
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 260 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPAGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLRIIDVAPLDVGAPDQEFGFDVGHVCFL

SEQ ID NO: 261 - protein, 1163 aa, Homo sapiens [sequence omitted]

SEQ ID NO: 262 - protein, 458 aa, Homo sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 263 - protein, 91 aa, Homo sapiens
ADGLKEPLSFHVTWIASFYNHSWKQNLVSGWLSDLQTHTWDSNSSTIVFLCPWSRGNFSNEEWKELETLFRIRTIRSFEGIRRYAHELQFE

SEQ ID NO: 264 - protein, 257 aa, Homo sapiens
MAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 265 - protein, 181 aa, Homo sapiens
SHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQLRAYLEGTCVEWLRRYLENGKETLQRA

SEQ ID NO: 266 - protein, 108 aa, Homo sapiens
TFCRVFLYFLYAADHVSTYAMFVQTHRPTGEFMFEFDEDEMFYVDLDKKETVWHLEEFGQAFSFEAQGGLANIAILNNNLNTLIQRSNHTQATNGTPYLCLFLCSPTG

SEQ ID NO: 267 - protein, 190 aa, Homo sapiens; identical to SEQ ID NO: 252

SEQ ID NO: 268 - protein, 359 aa, Homo sapiens
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASPQPLEELDHLLLLALMTVLFTMCSLPVIYRAYYGAFKDVKEKNRTSEEAEDLRALRFLSVISIVDPWIFIIFRSPVFRIFFHKIFIRPLRYRSRCSNSTNMESSL

SEQ ID NO: 269 - DNA, 2966 bp, Homo sapiens
cgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaatttatcgcgcttactatggagcatttaaggatgtcaaggagaaaaacaggacctctgaagaagcagaagacctccgagccttgcgatttctatctgtgatttcaattgtggacccttggatttttatcattttcagatctccagtatttcggatattttttcacaagattttcattagacctcttaggtacaggagccggtgcagcaattccactaacatggaatccagtctgtgacagtgtttttcactctgtggtaagctgaggaatatgtcacattttcagtcaaagaaccatgattaaaaaaaaaaagacaacttacaatttaaatccttaaaagttacctcccataacaaaagcatgtatatgtattttcaaaagtatttgatatcttaacaatgtgttaccattctatagtcatgaaccccttcagtgcattttcatttttttattaacagcaactaaaattttatatattgtaaccagtgttaaaagtcttaaaaaacaatggtattaattgtccctacatttgtgcttggtggccctattttttttttttagagaggccttgagacatacaggtcttttaaaatacagtagaaacaccactgtttacgattatacgatggacattcataaaaagcataatttcttaccctattcattttttggtgaaacctgattcattgattttatatcattgccgatgtttagttcatttctttgccaattgatctaagcatagcctgaattatgatgttcctcagagaagtgaggtgggaaatatgaccaggtcaggcagttggaggggcttccccagccaccatcggggagtacttgctgcctcaggtggagacctgaagctgtaactagatgcagagcaagatatgactatagcccacaacccaaagaagcaaaaattcgtttttatcttttgaaatccagtttcttttgtattgagtcaagggtgtcagtaggaatcaaaagttgggggtgggttgcaaaatgttctttcagtttttagaacctccattttataaaagaattatcctatcaatggattctttagtggaaggatttatgcttctttgaaaaccagtgtgtgactcactgtagagccatgtttactgtttgactgtgtggcacaggggggcatttggcacagcaaaaagcccacccaggacttagcctcagttgacgatagtaacaatggccttaacatctaccttaacagctacctattacagccgtattctgctgtccgtggagacggtaagatcttaggttccaagattttacttcaaattacaccttcaaaactggagcagcatatagccgaaaaggagcacaactgagcactttaatagtaatttaaaagttttcaagggtcagcaatatgatgactgaaagggaaaagtggaggaaacgcagctgcaactgaagcggagactctaaacccagcttgcaggtaagagctttcacctttggtaaaagaacagctggggaggttcaaggggtttcagcatctctggagttcctttgtatctgacaatctcaggactccaaggtgcaaagcctgctgcatttgcgtgatctcaagacctccagccagaagtcccttccaaatataagagtactcatgtttatttatttccaactgagcagcaacctcctttgtttcacttatgttttttccagtatctgagataatataaagctgggtaattttttatgtaattttttggtatagcaaaactgtgaaaaagccaaattaggcatacaaggagtatgatttaacagtatgacatgatgaaaaaaatacagttgtttttgaaatttaacttttgtttgtaccttcaatgtgtaagtacatgcatgttttattgtcagaggaagaacatgttttttgtattctttttttggagaggtgtgttaggataattgtccagttaatttgaaaaggccccagatgaatcaataaatataattttatagtaaaaaaaaaaaaaaaaaaaaaaaaa

SEQ ID NO: 270 - protein, 412 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 271 - protein, 332 aa, Homo sapiens
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 272 - protein, 562 aa, Homo sapiens
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 273 - protein, 152 aa, Homo sapiens
MPAHSLVMSSPALPAFLLCSTLLVIKMYVVAIITGQVRLRKKAFANPEDALRHGGPQYCRSDPDVERCLRAHRNDMETIYPFLFLGFVYSFLGPNPFVAWMHFLVFLVGRVAHTVAYLGKLRAPIRSVTYTLAQLPCASMALQILWEAARHL

SEQ ID NO: 274 - protein, 1091 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 275 - protein, 269 aa, Homo sapiens
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 276 - protein, 269 aa, Homo sapiens
MERLVIRMPFCHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 277 - DNA, 1038 bp, Homo sapiens; identical to SEQ ID NO: 9

SEQ ID NO: 278 - DNA, 2255 bp, Homo sapiens; identical to SEQ ID NO: 12

SEQ ID NO: 279 - DNA, 2880 bp, Homo sapiens; identical to SEQ ID NO: 43

SEQ ID NO: 280 - DNA, 893 bp, Homo sapiens
atgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggccctcaggtcgccctggccacactcacactcccagaaaactgcatcagaggaatatttttacatgaaaaataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctga

SEQ ID NO: 281 - DNA, 494 bp, Homo sapiens; identical to SEQ ID NO: 72

SEQ ID NO: 282 - DNA, 2416 bp, Homo sapiens; identical to SEQ ID NO: 45

SEQ ID NO: 283 - DNA, 700 bp, Homo sapiens; identical to SEQ ID NO: 46
  misc_feature (551)..(551): n is a, c, g, or t
  misc_feature (573)..(573): n is a, c, g, or t
  misc_feature (626)..(626): n is a, c, g, or t
  misc_feature (634)..(634): n is a, c, g, or t
  misc_feature (638)..(638): n is a, c, g, or t
  misc_feature (644)..(644): n is a, c, g, or t
  misc_feature (655)..(655): n is a, c, g, or t

SEQ ID NO: 284 - DNA, 2458 bp, Homo sapiens
ctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaaaaaaaaaaaaaaaaa

SEQ ID NO: 285 - DNA, 2469 bp, Homo sapiens
ttcggcacgagtgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctctgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttggaatgggtgggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactccaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttgcccatgcttggttgttgcagttcagacaaatgtgacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggccaaggcttgtaaatttacccaatgcagtttggctttttaaattattttgtgcctatttatgaataaatattaccaattctaaaagataagtgtgtttcccacaaaaaaaaaaaaaaaa

SEQ ID NO: 286 - DNA, 2507 bp, Homo sapiens; identical to SEQ ID NO: 56

SEQ ID NO: 287 - DNA, 813 bp, Homo sapiens; identical to SEQ ID NO: 57
  misc_feature (688)..(688): n is a, c, g, or t

SEQ ID NO: 288 - DNA, 1804 bp, Homo sapiens; identical to SEQ ID NO: 59

SEQ ID NO: 289 - DNA, 998 bp, Homo sapiens
gcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttccttaggacctgggggccaggctgacttggggggcagacttgacactaggccccactcactcagatgtcctgaaattccaccacgggggtcaccctggggggttagggacctatttttaacactaggggctggcccactaggagggctggccctaagatacagacccccccaactccccaaagcggggaggagatatttattttggggagagtttggaggggagggagaatttattaataaaagaatctttaactttaaaaaaaaaaaaaaaaa

SEQ ID NO: 290 - DNA, 1721 bp, Homo sapiens
caccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttcaaaaaaaaaaaaaaaaa

SEQ ID NO: 291 - DNA, 494 bp, Homo sapiens; identical to SEQ ID NO: 72

SEQ ID NO: 292 - DNA, 741 bp, Homo sapiens; identical to SEQ ID NO: 90
  misc_feature (492)..(492): n is a, c, g, or t
  misc_feature (652)..(652): n is a, c, g, or t
  misc_feature (696)..(696): n is a, c, g, or t
  misc_feature (707)..(707): n is a, c, g, or t

SEQ ID NO: 293 - DNA, 4231 bp, Homo sapiens
ggaaaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaagagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactgaaa

SEQ ID NO: 294 - DNA, 3851 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatac

SEQ ID NO: 295 - DNA, 1633 bp, Homo sapiens
gcccgccggagcagtcccggagcagaagcagcagcagcagcagcagccctcgccgttcgcggagcagccgagccggccatggcgttgtcgatgccgctgaatgggctgaaggaggagtacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaagcgcagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatccagtagggacgagttcaccaatgcctgtcccagtgataaggaggttgaaatagcatatagtgatgtagccaaaagactcaccaagtaaaatcgcgtttgtaaaagagatgtcttcatgtcttcccctaacaatacgcttttcccaacaggctactccttcccgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagagatattgtttcaatttagtctatcctggatatgtactaacgaatattaccaccagagaagagagctttctacaaaagtcactacagattttgctatattgctttggtagatagatttttacttttgcctaaaagcatttatccttcataccaatgtaacatctgacaccatgtagaagctaaaagtttagagggagtgagcgttttctcaagaccttcctcaagcattttatctttagaagagaaactgatgggcacctgatactctgtctaaatacgtttgttatatgtgttttcgg

SEQ ID NO: 296 - DNA, 739 bp, Homo sapiens
aattttaatgtttttactaaagaaagatataccattttattatgacactctagccatacattttcaaaatatgcttattaaacagtaaatgtaagataatgattcaattagttacatttttagaagtcattaggattgatattcctctgccataagtgaattgaataataatttcaaatacaatcagaattaatttaataaaaaatatgcttttcaactaagacagatgtaacgaatggccagtcattattttctggtttcaaagtagcaggggaaattaattcagtgtctgtaagtttatttatcacacttggcctataagtgtgataaaaatacatgaggcaaaatacatgatgtaatcccaattctcatagttcattaactcttttaccaaaaagatctgacatggtatttggggcctttatgtaaactgaatataagctgcgtgatatttgaaaggttttgatattttgaatagacattttcatgatacacagacacagataaaagatgtaagtagacagcttgaggtttcagagtccctcctgcagtgtgtttagcagcgggtacatgataaatatccaaacaaaatcagattaagggattaacagaagtgactttgctatgagttggtgagtggggtcaatgggtggcttgacagggattttagaggctctgttatatttttgctactttacatcagtgcattttgggcaaataaaatgagtaatgttacttt

SEQ ID NO: 297 - DNA, 2504 bp, Homo sapiens
gggacccactatcttgtggtttctgtcaagttcctgattttcatccgtagttgaagatgagcaagaactctgtaacagtgttaccttggagcctacaatgagaggtatttcaaaatgagtgaagcatgactctcacagatgaaggcctagacgcaggatctttaatgaaaaaacacttgggccacttcaagacgacaaacgctcactgggcaaaacaccttcactgaaaagagacctcatattatgcaaaaaaaatcttaaaaggcctctgccttcagaagttacaagatgatcaattcaacctccacacagcctccagatgaatcctgctctcagaacctcctgatcactcagcagatcattcctgtgctgtactgtatggtcttcattgcaggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggtctctgccgtgctcttctacgtcaacatgtacgtcagcattgtgttctttgggctcatcagctttgacagatattataaaattgtaaagcctctttggacttctttcatccagtcagtgagttacagcaaacttctgtcagtgatagtatggatgctcatgctcctccttgctgttccaaatattattctcaccaaccagagtgttagggaggttacacaaataaaatgtatagaactgaaaagtgaactgggacggaagtggcacaaagcatcaaactacatcttcgtggccatcttctggattgtgtttcttttgttaatcgttttctatactgctatcacaaagaaaatctttaagtcccaccttaagtcaagtcggaattccacttcggtcaaaaagaaatctagccgcaacatattcagcatcgtgtttgtgttttttgtctgttttgtaccttaccatattgccagaatcccctacacaaagagtcagaccgaagctcattacagctgccagtcaaaagaaatcttgcggtatatgaaagaattcactctgctactatctgctgcaaatgtatgcttggaccctattatttatttctttctatgccagccgtttagggaaatcttatgtaagaaattgcacattccattaaaagctcagaatgacctagacatttccagaatcaaaagaggaaatacaacacttgaaagcacagatactttgtgagttcctaccctcttccaaagaaagaccacgtgtgcatgttgtcatcttcaattacataacagaaatcaataagatatgtgccctcatcataaatatcatctctagcactgccatccaatttagttcaataaaattcaaatataagtttccatgcttttttgtaacatcaaagaaaacatacccatcagtaatttctctaatactgacctttctattctctattaataaaaaattaatacatacaattattcaattctattatattaaaataagttaaagtttataaccactagtctggtcagttaatgtagaaatttaaatagtaaataaaacacaacataatcaaagacaactcactcaggcatcttctttctctaaataccagaatctagtatgtaattgttttcaacactgtccttaaagactaacttgaaagcaggcacagtttgatgaagggctagagagctgtttgcaataaaaagtcaggtttttttcctgatttgaagaagcaggaaaagctgacacccagacaatcacttaagaaaccccttattgatgtatttcatggcactgcaaaggaagaggaatattaattgtatacttagcaagaaaattttttttttctgatagcactttgaggatattagatacatgctaaatatgttttctacaaagacttacgtcatttaatgagcctggggttctggtgttagaatatttttaagtaggctttactgagagaaactaaatattggcatacgttatcagcaacttcccctgttcaatagtatgggaaaaataagatgactgggaaaaagacacacccacaccgtagaacatatattaatctactggcgaatgggaaaggagaccattttcttagaaagcaaataaacttgatttttttaaatctaaaatttacattaatgagtgcaaaataacacataaaatgaaaattcacacatcacatttttctggaaaacagacggattttacttctggagacatggcatacggttactgacttatgagctaccaaaactaaattctttctctgctattaactggctagaagacattcatctatttttcaaatgttctttcaaaacatttttataagtaatgtttgtatctatttcatgctttactgtctatatactaataaagaaatgttttaatactgaaaaaaaaaaaaaaaa

SEQ ID NO: 298 - DNA, 1502 bp, Homo sapiens
cctgcgtccccgccccgcgcagccgccgcgctcctgcgctccgaggtccgaggttcccgagatgaaggtctggctgctgcttggtcttctgctggtgcacgaagcgctggaggatgttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctacgtggcggttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggatgaaaggcctgtgacgatccaagacacttggaggttgatccacagaggactgggacacaccacgagaatctcccagagtgtcattacagtggaagacttcgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaat

SEQ ID NO: 299 - DNA, 3653 bp, Homo sapiens
gcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtccccgagctccgcacagtgcgccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcacccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccgggccatgggccgctagcggtcctccagttcgggcccggcctccctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcagccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgccgcggcgcgggccgggggcgacggggatcgggacgccggctgcagggccgggggaggagcgcgtcggggctgccaaggcgtcgcgctggcgcgggcggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttgaagaaaaatgctaagggcagccctgcctgccctccccatcccccgctgtaaatatacactatttttgatagcacacatggggcccccatatctcttggccttggttttgatgttgaaatcctggccttgggagagatgccttccaggcagacacagctgtctggttcaggccaagcccctttgcaatgcaagccctttctggtgttatgaagtccctctatgtcgtcgttttcaccagcaactggtgactgtcccttcgacacggacctgctttgagatttcctgacagggaaaagatttctgtccatttttttcctgtgcctaacagcataattgccttttcctatgtaaatattatgatggtggatcaagacataagtaaatgagcctttctgcctcacatcagccctgtgtataaagccattattctctgatgcactgtttgccccagtaactcactttaaaacctctctttccagtgttccctctctccctccagggccactgcttgaagaagaatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaagaaaaactaatgtcagcacatgttgctaatgacagtggatttttttttaaataaaaaagtttacagatcaaatgtgaaataaatatgaatggagtggtcaaa

SEQ ID NO: 300 - DNA, 760 bp, Homo sapiens
gccaggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggccacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagc

SEQ ID NO: 301 - DNA, 502 bp, Homo sapiens
ctcacaccttgcatttcacccctgcatcccatgcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagccccgagtccgagtcaagcattgtgaattattactaactgggaacgaggacagaaggaaggacag

SEQ ID NO: 302 - DNA, 801 bp, Homo sapiens
cacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagt

SEQ ID NO: 303 - DNA, 4942 bp, Homo sapiens
aaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaa

SEQ ID NO: 304 - protein, 396 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 305 - protein, 406 aa, Homo sapiens
MLFHSLSGPEVHGVIDEMDRRAKSEAPAISSAIDRGDTETTMPSISSDRAALCAGCGGKISDRYYLLAVDKQWHMRCLKCCECKLNLESELTCFSKDGSIYCKEDYYRRFSVQRCARCHLGISASEMVMRARDLVYHLNCFTCTTCNKMLTTGDHFGMKDSLVYCRLHFEALLQGEYPAHFNHADVAAAAAAAAAAKSAGLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQVWFQNARAKFRRNLLRQENTGVDKSTDAALQTGTPSGPASELSNASLSPSSTPTTLTDLTSPTLPTVTSVLTSVPGNLEGHEPHSPSQTTLTNLF

SEQ ID NO: 306 - protein, 1170 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 307 - protein, 464 aa, Homo sapiens
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 308 - protein, 598 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 309 - protein, 335 aa, Homo sapiens
MVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 310 - protein, 202 aa, Homo sapiens
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 311 - protein, 422 aa, Homo sapiens
MPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGSILAGSCLYVGLPPEKPVNISCWSKNMKDLTCRWTPGAHGETFLHTNYSLKYKLRWYGQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWSEWSHPTAASTPRSERPGPGGGACEPRGGEPSSGPVRRELKQFLGWLKKHAYCSNLSFRLYDQWRAWMQKSHKTRNQDEGILPSGRRGTARGPAR

SEQ ID NO: 312 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 313 - protein, 472 aa, Homo sapiens
MATKCGNCGPGYSTPLEAMKGPREEIVYLPCIYRNTGTEAPDYLATVDVDPKSPQYCQVIHRLPMPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 314 - protein, 529 aa, Homo sapiens
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 315 - protein, 1158 aa, Homo sapiens
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 316 - protein, 574 aa, Homo sapiens
MRDPGAAAPLSSLGLCALVLALLGALSAGAGAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGPGGGPTAYPTAPYLPDLPFTALPPGASDGRGRPAFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 317 - protein, 253 aa, Homo sapiens
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 318 - protein, 153 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 319 - protein, 338 aa, Homo sapiens
MINSTSTQPPDESCSQNLLITQQIIPVLYCMVFIAGILLNGVSGWIFFYVPSSESFIIYLKNIVIADFVMSLTFPFKILGDSGLGPWQLNVFVCRVSAVLFYVNMYVSIVFFGLISFDRYYKIVKPLWTSFIQSVSYSKLLSVIVWMLMLLLAVPNIILTNQSVREVTQIKCIELKSELGRKWHKASNYIFVAIFWIVFLLLIVFYTAITKKIFKSHLKSSRNSTSVKKKSSRNIFSIVFVFFVCFVPYHIARIPYTKSQTEAHYSCQSKEILRYMKEFTLLLSAANVCLDPIIYFFLCQPFREILCKKLHIPLKAQNDLDISRIKRGNTTLESTDTL

SEQ ID NO: 320 - protein, 375 aa, Homo sapiens
MKVWLLLGLLLVHEALEDVTGQHLPKNKRPKEPGENRIKPTNKKVKPKIPKMKDRDSANSAPKTQSIMMQVLDKGRFQKPAATLSLLAGQTVELRCKGSRIGWSYPAYLDTFKDSRLSVKQNERYGQLTLVNSTSADTGEFSCWVQLCSGYICRKDEAKTGSTYIFFTEKGELFVPSPSYFDVVYLNPDRQAVVPCRVTVLSAKVTLHREFPAKEIPANGTDIVYDMKRGFVYLQPHSEHQGVVYCRAEAGGRSQISVKYQLLYVAVPSGPPSTTILASSNKVKSGDDISVLCTVLGEPDVEVEFTWIFPGQKDERPVTIQDTWRLIHRGLGHTTRISQSVITVEDFETIDAGYYICTAQNLQGQTTVATTVEFS

SEQ ID NO: 321 - protein, 450 aa, Homo sapiens
MGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 322 - protein, 98 aa, Homo sapiens
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 323 - protein, 1042 aa, Homo sapiens [sequence omitted]

What is claimed is:

1. A method of treating androgenetic alopecia (AGA) in a scalp of a subject, comprising the step of contacting said subject with an effective amount of a compound or composition comprising a prostaglandin D2 antagonist, thereby treating AGA in the scalp of the subject.

2. The method of claim 1, further comprising the step of contacting said subject with a pro-hair growth prostaglandin selected from a prostaglandin E1, a prostaglandin E2, a prostaglandin F2a; or an analogue thereof.

3. A method of treating androgenetic alopecia (AGA) in a scalp of a subject, comprising the step of contacting said subject with an effective amount of a prostaglandin (PG) D receptor (DP receptor) antagonist, thereby treating AGA in the scalp of the subject.

4. The method of claim 1, wherein said compound or composition decreases a level of a prostaglandin D2 in said scalp.

5. The method of claim 1, wherein the prostaglandin D2 antagonist is a prostaglandin (PG) D receptor (DP receptor) antagonist.

6. The method of claim 5, wherein the DP receptor antagonist is a CRTH2 (chemoattractant receptor-homologous molecule expressed on Th2 cells)/DP2 receptor antagonist.

7. The method of claim 3, wherein the DP receptor antagonist is a CRTH2 (chemoattractant receptor-homologous molecule expressed on Th2 cells)/DP2 receptor antagonist.

* * * * *